US012799481B2

(12) United States Patent
Spurbeck et al.

(10) Patent No.: US 12,799,481 B2
(45) Date of Patent: Nov. 17, 2026

(54) METHODS AND CONTROL COMPOSITIONS FOR SEQUENCING

(71) Applicant: BATTELLE MEMORIAL INSTITUTE, Columbus, OH (US)

(72) Inventors: Rachel R. Spurbeck, Columbus, OH (US); Richard Mon Che Chou, Columbus, OH (US); Anthony D. Duong, Columbus, OH (US)

(73) Assignee: BATTELLE MEMORIAL INSTITUTE, Columbus, OH (US)

( * ) Notice: Subject to any disclaimer, the term of this patent is extended or adjusted under 35 U.S.C. 154(b) by 17 days.

(21) Appl. No.: 18/614,028

(22) Filed: Mar. 22, 2024

(65) Prior Publication Data

US 2025/0179479 A1 Jun. 5, 2025

Related U.S. Application Data

(62) Division of application No. 16/418,515, filed on May 21, 2019, now Pat. No. 11,959,077.

(60) Provisional application No. 62/801,520, filed on Feb. 5, 2019, provisional application No. 62/703,266, filed on Jul. 25, 2018, provisional application No. 62/674,533, filed on May 21, 2018.

(51) Int. Cl.

| | |
|---|---|
| ***C12N 15/10*** | (2006.01) |
| ***C12N 15/113*** | (2010.01) |
| ***C12Q 1/6869*** | (2018.01) |
| ***C12Q 1/6876*** | (2018.01) |

(52) U.S. Cl.

CPC ........ *C12N 15/1089* (2013.01); *C12N 15/113* (2013.01); *C12Q 1/6869* (2013.01); *C12Q 1/6876* (2013.01); *C12Q 2563/185* (2013.01); *C12Q 2600/166* (2013.01)

(58) Field of Classification Search

None

See application file for complete search history.

(56) References Cited

U.S. PATENT DOCUMENTS

| | | | |
|---|---|---|---|
| 2006/0058249 | A1 | 3/2006 | Tong et al. |
| 2006/0073506 | A1 | 4/2006 | Frederick |
| 2007/0072212 | A1 | 3/2007 | Vinayagamoorthy |
| 2008/0254453 | A1 | 10/2008 | Shapero |
| 2010/0240064 | A1 | 9/2010 | Jeddeloh |
| 2011/0076726 | A1 | 3/2011 | Lakey |
| 2012/0208193 | A1 | 8/2012 | Okino |
| 2015/0322508 | A1 | 11/2015 | Miguel |
| 2016/0257984 | A1 | 9/2016 | Hardenbol et al. |
| 2016/0257993 | A1 | 9/2016 | Fu et al. |
| 2016/0281182 | A1 | 9/2016 | Monpoeho et al. |
| 2017/0275691 | A1 | 9/2017 | Christians et al. |
| 2017/0292149 | A1 | 10/2017 | Sherwood |
| 2019/0300948 | A1 | 10/2019 | Cuppens |
| 2020/0277672 | A1 | 9/2020 | Freeman |

FOREIGN PATENT DOCUMENTS

| | | | |
|---|---|---|---|
| CN | 115058354 | * | 9/2022 |
| EP | 3246412 | A1 | 11/2017 |
| WO | 2004083819 | A2 | 9/2004 |
| WO | 2009/036525 | A2 | 3/2009 |
| WO | 2011/156795 | | 12/2011 |
| WO | 2016179530 | A1 | 11/2016 |
| WO | 2017058936 | A1 | 4/2017 |
| WO | 2017/165864 | A1 | 9/2017 |
| WO | 2017192974 | A1 | 11/2017 |
| WO | 2018119301 | A1 | 6/2018 |
| WO | 2019/226648 | A1 | 11/2019 |

OTHER PUBLICATIONS

Wei et al. pBACode: a random-barcode-based high-throughput approach for BAC paired-end sequencing and physical clone mapping 2017, NAR vol. 45, No. 7 e52 doi: 10.1093/nar/gkw1261.*
Koulouras et al. Significant non-existence of sequences in genomes and proteomes, Nucleic Acids Research, 2021, vol. 49, No. 6 3139-3155 doi: 10.1093/nar/gkab139.*
Van Meer G, Voelker DR, Feigenson GW. Membrane lipids: where they are and how they behave. Nat Rev Mol Cell Biol. Feb. 2008; 9(2):112-24. doi: 10.1038/nrm2330. PMID: 18216768; PMCID: PMC2642958.*
Epand et al. Lipid domains in bacterial membranes and the action of antimicrobial agents Biochimica et Biophysica Acta (BBA)—Biomembranes vol. 1788, Issue 1, Jan. 2009, pp. 289-294 https://doi.org/10.1016/j.bbamem.2008.08.023.*
International Search Report for PCT/US19/66326 mail Apr. 6, 2020.
Kozarewa et al. Nature Methods 2009; 6:291-295.
Extended European Search Report prepared for EP Application 19808336.2, mailed Feb. 4, 2022.
Jiang, L. et al., "Synthetic spike-in standards for RNA-seq experiments," Genome Research, 2011, 21(9) 1543-51.
Supplementary European Search Report, completed May 20, 2022, for EP 19894954.
Kaifu Chen et al. The Overlooked Fact: Fundamental Need for Spike-In Control for Virtually All Genome-Wide Analysis Molecular and Cellular Biology March 206 vol. 36 No. 5.
Qu et al. Development of ERCC RNA Spike-In Control Mixes J. Biomol. Tech. Oct. 2011; 22(Suppl): S46.
Wong et al. ANAQUIN: a software toolkit for the analysis of spike-in controls for next generation sequencing Bioinformatics, 33(11), 2017, 1723-1724. doi: 10.1093/bioinformatics/btx038 Advance Access Publication Date: Jan. 27, 2017.
Chen et al. Effects of GC Bias in Next-Generation-Sequencing data on De Novo Genome Assembly PLoS ONE 8(4): e62856. doi: 10.137/journal.pone.0062856.

(Continued)

*Primary Examiner* — Joseph Woitach
(74) *Attorney, Agent, or Firm* — Barnes & Thornburg

(57) ABSTRACT

The invention relates to control compositions for sequencing and for chemical analyses, such as analytical chemistry analyses. More particularly, the invention relates to control compositions for sequencing and for chemical analyses having at least one barcode sequence fragment and at least one universal sequence fragment, and to methods of their use.

12 Claims, 14 Drawing Sheets

Specification includes a Sequence Listing.

(56) References Cited

OTHER PUBLICATIONS

O'Connell et al.(High Interspecimen Variability in Nucleic Acid Extraction Efficiency Necessitates the Use of Spike-In Control for Accurate qPCR-based Measurement of Plasma Cell-Free DNA Levels, Laboratory Medicine 48:4:332-338, DOI: 10.1093/labmed/lmx043.
Stoeckel et al.Water Research 42 4820-4827, Jun. 4, 2009.
Zhang et al (Results of first proficiency test for KRAS testing with formalin-fixed, paraffin-embedded cell lines in China, Clin Chem Lab Med 2014; 52(12): 1851-1857.
Sundquist et al.Identifying and Preventing DNA Contamination in a DNA-Typing Laboratory Promega.com, Sep. 2005.
Kojima et al. Nucleic Acids Research, 2005, 33(17) e 150.
Dauphin et al. Journal of Applied Microbiology, 2010, 108, 163-72.
Hammer et al. FEBS Letters, 2012, 586, 1882-90.
Zelikin et al. ACSNANO, 2007, 1(1) 63-9.
Quaile et al. BMC Genomics 2014, 15:110 http://www.biomedcentral.com/4171-2164/15/110 ; doi:10.1186/1471-2164-15-110.
PCT Search Report and Written Opinion prepared for PCT/US2019/033311, mailed Oct. 23, 2019.

* cited by examiner

FIG. 3A
Bacteria
Proteobacteria
Alphaproteobacteria
Sphingomonadales
Sphingomonadaceae
Betaproteobacteria
Burkholderiales
Oxalobacteraceae
Comamonadaceae
Massilia
Gammapro... bacteria
Bacteroidetes
Flavobacteriaceae
Flavobacterium
Chryseobacterium
Pedobacter
Luteolibacter
Novosphingobium naphthalenivorans
Novosphingobium gossypii
'Novosphingobium aquaticum' Singh et al. 2015
Novosphingobium piscinae
Sphingomonas aquatilis
Sphingomonas kyeonggiensis
Sphingomonas lutea
Sphingomonas starnbergensis
Sphingobium vulgare
Sphingobium hydrophobicum
Sphingobium rhizovicinum
Sphingobium boeckii
Sphingopyxis fribergensis
Lysobacter ginsengisoli
Flavobacterium aquatile
Flavobacterium terrigena
Flavobacterium reichenbachii
Flavobacterium paronense
Flavobacterium fructae
Flavobacterium nitratireducens
Flavobacterium pectinovorum
Flavobacterium macrobrachii
Flavobacterium fryxellicola
Flavobacterium branchiarum
Flavobacterium hercynium
Flavobacterium saliperosum
Flavobacterium limnosediminis
Flavobacterium succinicans
Flavobacterium rivuli
Flavobacterium granuli
Flavobacterium hydatis
Flavobacterium sinopsychrotolerans
Chryseobacterium arthropi
Pedobacter lotistagni
Pedobacter glacialis
Pedobacter borealis
Pedobacter bambusae
Luteolibacter pohnpeiensis
Massilia jejuensis
Massilia varians
Massilia brevitalea
Massilia psychrophila
Massilia niabensis
Massilia aurea
Massilia eurypsychrophila
Massilia suwonensis
Massilia umbonata
Oxalicibacterium solurbis
Ramlibacter ginsenosidimutans
Limnohabitans parvus
Polaromonas jejuensis
Kinneretia asaccharophila
Variovorax soli
Hydrogenophaga caeni
Comamonas terrigena
Caenimonas koreensis
Xenophilus aerolatus

| Soil Sample | Count R1 | Count R2 | Raw Read Count | Ccc1 Identification |
|---|---|---|---|---|
| CCC1-ENCAPSULATED | 173,762 | 2 | 250,385 | 69% |
| CCC1-NONENCAPSULATED | 214,749 | 1 | 290,048 | 74% |
| CCC2-ENCAPSULATED | 385 | 0 | 202,662 | 0% |
| CCC2-NONENCAPSULATED | 375 | 0 | 182,636 | 0% |
| CCC1-CCC2-ENCAPSULATED | 83,406 | 1 | 175,396 | 48% |

| Soil Sample | Count R1 | Count R2 | Raw Read Count | CCC2 Identification |
|---|---|---|---|---|
| CCC1-ENCAPSULATED | 1,437 | 0 | 250,385 | 1% |
| CCC1-NONENCAPSULATED | 631 | 0 | 290,048 | 0% |
| CCC2-ENCAPSULATED | 121,097 | 1 | 202,662 | 60% |
| CCC2-NONENCAPSULATED | 122,405 | 1 | 182,636 | 67% |
| CCC1-CCC2-ENCAPSULATED | 53,703 | 1 | 175,396 | 31% |

*FIG. 4*

Low Quantity Standard

High Quantity Standard

METHODS AND CONTROL COMPOSITIONS FOR SEQUENCING

CROSS-REFERENCE TO RELATED APPLICATIONS

This application is a division of U.S. application Ser. No. 16/418,515, filed on May 21, 2019, which claims priority under 35 U.S.C. § 119(e) to U.S. Provisional Application Ser. No. 62/674,533 filed on May 21, 2018, U.S. Provisional Application Ser. No. 62/703,266 filed on Jul. 25, 2018 and U.S. Provisional Application Ser. No. 62/801,520 filed on Feb. 5, 2019, the entire disclosures of which are incorporated herein by reference.

SEQUENCE LISTING

Incorporated by reference in its entirety is a computer-readable nucleotide/amino acid sequence listing identified as follows: 3,920 kilobytes xml file named "920006407671.xml," created on Feb. 18, 2025.

FIELD OF THE DISCLOSURE

The invention relates to control compositions for sequencing and chemical analyses. More particularly, the invention relates to control compositions for sequencing and chemical analyses having at least one barcode sequence fragment and at least one universal sequence fragment, and to methods of their use.

BACKGROUND AND SUMMARY OF THE INVENTION

Sequencing controls are needed that can be used starting after the extraction step (e.g., by spiking the extract with the control constructs) or in every step of analysis of an unknown test sample (e.g., from nucleic acid extraction to nucleic acid purification to library preparation and sequencing). Sample swapping or sample-to-sample contamination can occur during any of these steps, but without a priori knowledge of what is in the sample, one may not know if the samples were contaminated or just contained similar genetic profiles. Also, sequencing controls that can be used both for 1) detection of sample swapping and sample-to-sample contamination, and 2) quantitation are needed.

For quantitation, metagenomic communities are currently analyzed by determining the relative abundance of 16S genes or unique k-mers that can differentiate microbial species and strains. However, the methods used to process the samples can influence the relative abundance of the community members. For example, during DNA extraction, the chemical or physical lysis process can bias the analysis due to different lysis efficiencies for different microbial membranes or cell wall compositions (e.g., fungi typically are underrepresented in metagenomes due to lysis resistance). After DNA extraction, the library preparation method can also add additional bias. As an example, amplification of library molecules relies on polymerases which can bias results towards fifty percent GC content fragments or shorter fragments versus longer molecules, as polymerases tend to amplify shorter fragments and lower GC content or balanced molecules faster than molecules with high GC content.

Analytical chemistry analysis of unknown materials can be confounded by identification of compounds that do not seem to fit with what is expected. These unexpected compounds could be the result of a cross contamination event or may actually be present in the sample. Therefore, spike-in cross contamination and sample swapping controls are also needed for analytical chemistry analyses.

The present invention provides sequencing controls that can be used starting after the extraction step (e.g., by spiking the extract with the control constructs) or in every step of analysis of an unknown test sample (e.g., from nucleic acid extraction to nucleic acid purification to library preparation and sequencing). In one embodiment, nucleic acid constructs comprising a barcode sequence fragment are provided that can be encapsulated in a simulated cell membrane (e.g., a simulated bacterial cell membrane or eukaryotic cell membrane), or embedded directly in the genome of an organism for use as spike-in sequencing controls. In one aspect, the barcode sequence fragment comprises a unique sequence not present in any known genome. In one embodiment, the sequencing controls can be spiked into the unknown test sample prior to or after nucleic acid extraction and then can be detected in the final sequenced samples. In another embodiment, different nucleic acid constructs (i.e., with different barcode sequence fragments) can be spiked into different samples so that cross-contamination of samples or sample swapping can be detected.

In one embodiment, the barcode sequence fragment can be flanked by universal sequence fragments. The universal sequence fragments can add length to the nucleic acid construct and can serve as markers for bioinformatic analysis to identify the beginning and end of the barcode sequence fragment after sequencing. In another illustrative aspect, the barcode sequence fragment may be flanked by primer binding site sequence fragments (i.e., directly or indirectly linked to the barcode sequence fragment) so that the nucleic acid construct comprising the barcode sequence fragment can be amplified during an amplicon sequencing protocol. In another embodiment, primer binding site sequence fragments may be lacking for use of the sequencing controls in whole genome sequencing protocols. In another embodiment, a set of different nucleic acid construct spike-ins with different barcode sequence fragments (e.g., 384 or 96 different barcode sequence fragments) can be used to allow for multiplexing of samples on one sequencing run.

In various embodiments, samples with microorganisms containing nucleic acids (e.g., DNA), or samples with other sources of nucleic acids, may be analyzed by sequencing using the control compositions for sequencing described herein. The samples can be, for example, selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, and an animal sample.

In another embodiment, a method is provided for the use of spike-in controls that simultaneously 1) control for cross-contamination and/or sample swapping and 2) allow for quantitation while controlling for different GC content samples (e.g., low, balanced, and high GC content) and/or for different lysis efficiencies. In one aspect, barcoded DNA molecules are produced with different GC contents, using GC content fragments, wherein the barcode sequence fragments and the GC content fragments are flanked by universal sequence fragments, and then the nucleic acid construct is encapsulated in a simulated cell membrane. By using the same type of nucleic acid construct, but with different barcode sequence fragments, different quantities of the encapsulated nucleic acid construct can be spiked-in, and a standard curve for quantitation can be produced. In this embodiment, the barcode sequence fragments can be used to verify that no cross-contamination or sample swapping occurred during sample preparation or processing. Also in this quantitation embodiment, the different GC content fragments (e.g., low, balanced, and high GC content) have the same barcode sequence fragment at each GC percentage (e.g., low, balanced, and high GC content), but at each separate concentration of the nucleic acid construct used to produce the standard curve, the barcode sequence fragments are unique to each concentration used to produce the standard curve. In this embodiment, the encapsulation method can also be varied to control for different resistances to lysis to mimic, for example, Gram positive, Gram negative, and fungal cell walls. In this encapsulation embodiment, the type of encapsulation method can be correlated to a unique barcode sequence fragment in the nucleic acid construct to enable differentiation post sequencing.

The present invention also provides spike-in cross-contamination and sample swapping controls for analytical chemistry analysis of unknown materials. These controls can be used in analytical chemistry procedures, such as mass spectrometry.

The following clauses, and combinations thereof, provide various additional illustrative aspects of the invention described herein. The various embodiments described in any other section of this patent application, including the section titled "DETAILED DESCRIPTION OF ILLUSTRATIVE EMBODIMENTS" and the "EXAMPLES" are applicable to any of the following embodiments of the invention described in the numbered clauses below.

1. A sequencing control composition, said control composition comprising a nucleic acid construct comprising at least one barcode sequence fragment linked at its 5' or 3' end to at least one universal sequence fragment.
2. The control composition of clause 1 wherein the control composition is used to determine if cross-contamination between samples for sequencing has occurred.
3. The control composition of clause 1 wherein the control composition is used to determine if sample swapping has occurred.
4. The control composition of any one of clauses 1 to 3 wherein the nucleic acid construct is a deoxyribonucleic acid construct.
5. The control composition of any one of clauses 1 to 4 wherein the nucleic acid construct comprises at least a first and a second universal sequence fragment.
6. The control composition of clause 5 wherein the first universal sequence fragment is linked to the 5' end of the barcode sequence fragment and the second universal sequence fragment is linked to the 3' end of the barcode sequence fragment.
7. The control composition of any one of clauses 1 to 6 wherein the nucleic acid construct further comprises at least a first and a second primer binding site fragment.
8. The control composition of clause 6 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
9. The control composition of clause 8 wherein the primer binding site fragments range in length from about 15 base pairs to about 30 base pairs.
10. The control composition of clause 8 wherein the nucleic acid construct ranges in length from about 80 base pairs to about 300 base pairs.
11. The control composition of any one of clauses 1 to 6 wherein the sequencing is whole genome sequencing.
12. The control composition of any one of clauses 7 to 10 wherein the sequencing is amplicon sequencing.
13. The control composition of any one of clauses 1 to 12 wherein the sequencing is Next
Generation Sequencing.
14. The control composition of any one of clauses 1 to 13 wherein the nucleic acid construct is encapsulated.
15. The control composition of clause 14 wherein the nucleic acid construct is encapsulated in a liposome.
16. The control composition of clause 15 wherein the liposome comprises a lipid selected from the group consisting of cholesterol, a lipopolysaccharide, a peptidoglycan, a PEG, a teichoic acid, a phospholipid, and combinations thereof.
17. The control composition of any one of clauses 1 to 13 wherein the nucleic acid construct is incorporated into the genome of a microorganism.
18. The control composition of any one of clauses 1 to 17 wherein the barcode sequence fragment comprises a unique sequence not present in any known genome.
19. The control composition of any one of clauses 12 to 16 wherein the nucleic acid construct is incorporated into a plasmid.
20. A kit comprising the control composition of any one of clauses 1 to 19.
21. The kit of clause 20 further comprising a reagent for nucleic acid extraction.
22. The kit of clause 20 or 21 further comprising a reagent for nucleic acid purification.
23. The kit of any one of clauses 20 to 22 further comprising a reagent for library preparation.
24. The kit of any one of clauses 20 to 23 further comprising a probe.
25 The kit of any one of clauses 20 to 24 further comprising a reagent for sequencing.
26. The kit of any one of clauses 20 to 25 wherein the kit comprises more than one control composition of any one of clauses 1 to 19 wherein each control composition comprises a different nucleic acid construct wherein the different nucleic acid constructs comprise different barcode sequence fragments.
27. A method for monitoring cross-contamination or sample swapping over all steps of a DNA sequencing protocol including collection of a sample comprising DNA, DNA extraction from the sample, purification of the extracted DNA, library preparation, and sequencing, the method comprising,
    a) spiking the sample with a control composition comprising a nucleic acid construct wherein the nucleic acid construct comprises at least one barcode sequence fragment linked to at least one universal sequence fragment and wherein the nucleic acid construct is a deoxyribonucleic acid construct;
    b) extracting total DNA wherein total DNA comprises the DNA from the sample and DNA from the nucleic acid construct;
    c) purifying total DNA;

d) preparing a library from total DNA;
e) sequencing the extracted, purified total DNA; and
f) detecting the nucleic acid construct in total DNA.

28. The method of clause 27 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.
29. The method of clause 27 or 28 wherein the method is used to determine if cross-contamination between samples has occurred.
30. The method of clause 27 or 28 wherein the method is used to determine if sample swapping has occurred.
31. The method of any one of clauses 27 to 30 wherein the step of preparing the library from total DNA comprises a step of amplifying the nucleic acid construct.
32. The method of any one of clauses 27 to 31 wherein the nucleic acid construct comprises at least a first and a second universal sequence fragment.
33. The method of clause 32 wherein the first universal sequence fragment is linked to the 5' end of the barcode sequence fragment and the second universal sequence fragment is linked to the 3' end of the barcode sequence fragment.
34. The method of any one of clauses 27 to 33 wherein the nucleic acid construct further comprises at least a first and a second primer binding site fragment.
35. The method of clause 34 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
36. The method of clause 35 wherein the primer binding site fragments range in length from about 15 base pairs to about 30 base pairs.
37. The method of clause 35 wherein the nucleic acid construct ranges in length from about 80 base pairs to about 300 base pairs.
38. The method of any one of clauses 27 to 33 wherein the sequencing is whole genome sequencing.
39. The method of any one of clauses 34 to 37 wherein the sequencing is amplicon sequencing.
40. The method of any one of clauses 27 to 39 wherein the sequencing is Next Generation Sequencing.
41. The method of any one of clauses 27 to 40 wherein the nucleic acid construct is encapsulated.
42. The method of clause 41 wherein the nucleic acid construct is encapsulated in a liposome.
43. The method of clause 42 wherein the liposome comprises a lipid selected from the group consisting of cholesterol, a lipopolysaccharide, a peptidoglycan, a PEG, a teichoic acid, a phospholipid, and combinations thereof.
44. The method of any one of clauses 27 to 40 wherein the nucleic acid construct is incorporated into the genome of a microorganism.
45. The method of any one of clauses 27 to 44 wherein the barcode sequence fragment comprises a unique sequence not present in any known genome.
46. The method of any one of clauses 39 to 43 wherein the nucleic acid construct is incorporated into a plasmid.
47. The method of any one of clauses 26 to 33 or 41 to 45 wherein the library preparation step further comprises the step of hybridizing the nucleic acid construct to an immobilized probe before sequencing the nucleic acid construct.
48. The method of clause 47 wherein the probe comprises sequences complementary to the universal sequence fragments in the nucleic acid construct and wherein the probe does not hybridize to the barcode sequence fragment in the nucleic acid construct.
49. The method of any one of clauses 27 to 48 wherein detecting the nucleic acid construct in total DNA comprises
 i) identifying the universal sequence fragment in a sequencing read generated by sequencing the extracted, purified total DNA;
 ii) comparing a sequence fragment adjacent the universal sequence fragment in the sequencing read to the barcode sequence fragment; and
 iii) determining that cross-contamination or sample swapping has occurred in response to the sequence fragment adjacent the universal sequence fragment not matching the barcode sequence fragment.
50. The method of any one of clauses 32 to 48 wherein detecting the nucleic acid construct in total DNA comprises
 i) identifying the first and second universal sequence fragments in a sequencing read generated by sequencing the extracted, purified total DNA;
 ii) comparing a sequence fragment located between the first and second universal sequence fragments in the sequencing read to the barcode sequence fragment; and
 iii) determining that cross-contamination or sample swapping has occurred in response to the sequence fragment located between the first and second universal sequence fragments not matching the barcode sequence fragment.
51. The method of clause 49 or 50, wherein the identifying and comparing steps are performed using a text-matching algorithm.
52. The method of any one of clauses 49 to 51 wherein the identifying step comprises referencing a database of universal sequence fragments that may be included in the nucleic acid construct of the control composition.
53. The method of any one of clauses 49 to 52 wherein the comparing step comprises referencing a database of barcode sequence fragments that may be included in the nucleic acid construct of the control composition.
54. A sequencing control composition, said control composition comprising a nucleic acid construct comprising at least one barcode sequence fragment, at least one universal sequence fragment, and at least one GC content fragment.
55. The control composition of clause 54 wherein one or more of the GC content fragments has a GC content of about 1 to about 40 percent.
56. The control composition of clause 54 wherein one or more of the GC content fragments has a GC content of about 40 to about 60 percent.

57. The control composition of clause 54 wherein one or more of the GC content fragments has a GC content of about 60 to about 100 percent.
58. The control composition of any one of clauses 54 to 57 comprising nucleic acid constructs with GC content fragments with at least two different percent GC contents.
59. The control composition of any one of clauses 54 to 58 comprising nucleic acid constructs with GC content fragments with at least three different percent GC contents.
60. The control composition of any one of clauses 54 to 59 comprising nucleic acid constructs with GC content fragments with at least four different percent GC contents.
61. The control composition of clause 59 wherein the percent GC contents are about 1 to about 40 percent, about 40 percent to about 60 percent, and about 60 percent to about 100 percent.
62. The control composition of any one of clauses 54 to 61 wherein the control composition is used to determine if cross-contamination between samples for sequencing has occurred.
63. The control composition of any one of clauses 54 to 62 wherein the control composition is used to determine if sample swapping has occurred.
64. The control composition of any one of clauses 54 to 63 wherein the GC content fragment is used to control for polymerase, transposase, ligase, or repair enzyme GC content bias.
65. The control composition of any one of clauses 54 to 64 wherein the control composition is used for quantification of nucleic acids during sequencing.
66. The control composition of any one of clauses 54 to 65 wherein the nucleic acid construct is a deoxyribonucleic acid construct.
67. The control composition of any one of clauses 54 to 66 wherein the nucleic acid construct comprises at least a first and a second universal sequence fragment.
68. The control composition of clause 67 wherein the first universal sequence fragment is linked to the 5' end of the barcode sequence fragment, the barcode sequence fragment is between the first universal sequence fragment and the GC content fragment, and the second universal sequence fragment is linked to the 3' end of the GC content fragment.
69. The control composition of any one of clauses 67 to 68 wherein the nucleic acid construct further comprises at least a first and a second primer binding site fragment.
70. The control composition of clause 69 wherein the first primer binding site fragment is linked at its 3' end to the 5' end of the first universal sequence fragment and the second primer binding site fragment is linked at its 5' end to the 3' end of the second universal sequence fragment.
71. The control composition of any one of clauses 69 to 70 wherein the primer binding site fragments range in length from about 15 base pairs to about 30 base pairs.
72. The control composition of any one of clauses 54 to 71 wherein the nucleic acid construct ranges in length from about 80 base pairs to about 300 base pairs.
73. The control composition of any one of clauses 54 to 68 wherein the sequencing is whole genome sequencing.
74. The control composition of any one of clauses 69 to 72 wherein the sequencing is amplicon sequencing.
75. The control composition of any one of clauses 54 to 74 wherein the sequencing is Next Generation Sequencing.
76. The control composition of any one of clauses 54 to 75 wherein the nucleic acid construct is encapsulated.
77. The control composition of clause 76 wherein the nucleic acid construct is encapsulated in a liposome.
78. The control composition of clause 77 wherein the liposome comprises a lipid selected from the group consisting of cholesterol, a lipopolysaccharide, a peptidoglycan, a PEG, a teichoic acid, a phospholipid, and combinations thereof.
79. The control composition of any one of clauses 54 to 78 wherein the barcode sequence fragment comprises a unique sequence not present in any known genome.
80. The control composition of any one of clauses 54 to 75 wherein the nucleic acid construct is incorporated into the genome of a microorganism.
81. The control composition of any one of clauses 74 to 79 wherein the nucleic acid construct is incorporated into a plasmid.
82. A kit comprising the control composition of any one of clauses 54 to 81.
83. The kit of clause 82 further comprising a reagent for nucleic acid extraction.
84. The kit of clause 82 or 83 further comprising a reagent for nucleic acid purification.
85. The kit of any one of clauses 82 to 84 further comprising a reagent for library preparation.
86. The kit of any one of clauses 82 to 85 further comprising a probe.
87. The kit of any one of clauses 82 to 86 further comprising a reagent for sequencing.
88. The kit of any one of clauses 82 to 87 wherein the kit comprises more than one control composition of any one of clauses 54 to 81 wherein each control composition comprises a different nucleic acid construct wherein the different nucleic acid constructs comprise different barcode sequence fragments.
89. The kit of any one of clauses 82 to 88 wherein the kit comprises more than one control composition of any one of clauses 54 to 81 and wherein the nucleic acid construct in each control composition is encapsulated in a different type of liposome.
90. A method for monitoring sample cross-contamination and/or sample swapping and for quantification of nucleic acids during sequencing, the method comprising,
  a) extracting DNA from a sample;
  b) purifying the DNA;
  c) spiking the sample, after DNA extraction and purification and before library preparation, with a control composition comprising a nucleic acid construct wherein the nucleic acid construct comprises at least one barcode sequence fragment, at least one universal sequence fragment, and at least one GC content fragment, and wherein the nucleic acid construct is a deoxyribonucleic acid construct, wherein total DNA is obtained after spiking the sample, and wherein total DNA comprises the DNA from the sample and the DNA from the nucleic acid construct;
  d) preparing a library from total DNA;
  e) sequencing total DNA; and
  f) detecting and quantifying the nucleic acid construct in total DNA.

91. A method for monitoring sample cross-contamination and/or sample swapping and for quantification of nucleic acids during sequencing, the method comprising,
   a) spiking a sample with a control composition comprising a nucleic acid construct wherein the nucleic acid construct comprises at least one barcode sequence fragment, at least one universal sequence fragment, and at least one GC content fragment and wherein the nucleic acid construct is a deoxyribonucleic acid construct;
   b) extracting total DNA from the sample wherein total DNA comprises the DNA from the sample and the DNA from the nucleic acid construct;
   c) purifying total DNA;
   d) preparing a library from total DNA;
   e) sequencing total DNA; and
   f) detecting and quantifying the nucleic acid construct in total DNA.
92. The method of clause 91 wherein sample cross-contamination and/or sample swapping can be monitored over all steps of a DNA sequencing protocol including collection of the sample, extraction of total DNA, purification of the extracted total DNA, library preparation, and sequencing.
93. The method of any one of clauses 90 to 92 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.
94. The method of any one of clauses 90 to 93 wherein the step of preparing the library from total DNA comprises a step of amplifying the nucleic acid construct.
95. The method of any one of clauses 90 to 94 wherein one of the GC content fragments has a GC content of about 1 to about 40 percent.
96. The method of any one of clauses 90 to 94 wherein one of the GC content fragments has a GC content of about 40 to about 60 percent.
97. The method of any one of clauses 90 to 94 wherein one of the GC content fragments has a GC content of about 60 to about 100 percent.
98. The method of any one of clauses 90 to 97 wherein the control composition comprises nucleic acid constructs with GC content fragments with at least two different percent GC contents.
99. The method of any one of clauses 90 to 98 wherein the control composition comprises nucleic acid constructs with GC content fragments with at least three different percent GC contents.
100. The method of any one of clauses 90 to 99 wherein the control composition comprises nucleic acid constructs with GC content fragments with at least four different percent GC contents.
101. The method of clause 99 wherein the GC contents are about 1 to about 40 percent, about 40 percent to about 60 percent, and about 60 percent to about 100 percent.
102. The method of any one of clauses 90 to 101 wherein the GC content fragment is used to control for polymerase, transposase, ligase, or repair enzyme GC content bias.
103. The method of any one of clauses 90 to 102 wherein the nucleic acid construct is present at at least two different concentrations for use in generating a standard curve for the quantification of nucleic acids during sequencing.
104. The method of any one of clauses 90 to 103 wherein the nucleic acid construct is present at at least three different concentrations for use in generating a standard curve for the quantification of nucleic acids during sequencing.
105. The method of any one of clauses 90 to 104 wherein the nucleic acid construct is present at at least four different concentrations for use in generating a standard curve for the quantification of nucleic acids during sequencing.
106. The method of any one of clauses 90 to 105 wherein the nucleic acid construct is present at at least five different concentrations for use in generating a standard curve for the quantification of nucleic acids during sequencing.
107. The method of any one of clauses 103 to 106 wherein a different bar code sequence fragment is present in the nucleic acid construct at each of the different concentrations of the nucleic acid construct.
108. The method of clause 107 wherein at each of the different concentrations of the nucleic construct, the control composition comprises multiple nucleic acid constructs with different percent GC contents but with the same barcode sequence fragment for the nucleic acid constructs with different percent GC contents.
109. The method of any one of clauses 90 to 108 wherein the barcode sequence fragment comprises a unique sequence not present in any known genome.
110. The method of any one of clauses 90 to 109 wherein the nucleic acid construct comprises at least a first and a second universal sequence fragment.
111. The method of clause 110 wherein the first universal sequence fragment is linked to the 5' end of the barcode sequence fragment, the barcode sequence fragment is between the first universal sequence fragment and the GC content fragment, and the second universal sequence fragment is linked to the 3' end of the GC content fragment.
112. The method of any one of clauses 109 to 111 wherein the nucleic acid construct further comprises at least a first and a second primer binding site fragment.
113. The method of clause 112 wherein the first primer binding site fragment is linked at its 3' end to the 5' end of the first universal sequence fragment and the second primer binding site fragment is linked at its 5' end to the 3' end of the second universal sequence fragment.
114. The method of any one of clauses 112 to 113 wherein the primer binding site fragments range in length from about 15 base pairs to about 30 base pairs.
115. The method of any one of clauses 90 to 114 wherein the nucleic acid construct ranges in length from about 80 base pairs to about 300 base pairs.
116. The method of any one of clauses 90 to 111 wherein the sequencing is whole genome sequencing.
117. The method of any one of clauses 112 to 115 wherein the sequencing is amplicon sequencing.
118. The method of any one of clauses 90 to 117 wherein the sequencing is Next Generation Sequencing.

119. The method of any one of clauses 91 to 118 wherein the nucleic acid construct is encapsulated.
120. The method of clause 119 wherein the nucleic acid construct is encapsulated in a liposome.
121. The method of clause 120 wherein the liposome comprises a lipid selected from the group consisting of cholesterol, a lipopolysaccharide, a peptidoglycan, a PEG, a teichoic acid, a phospholipid, and combinations thereof.
122. The method of any one of clauses 119 to 121 wherein more than one type of control composition is used in the method wherein the nucleic acid construct in each type of control composition is encapsulated in a different type of liposome.
123. The method of clause 122 wherein each type of control composition with the nucleic acid construct encapsulated in a different type of liposome comprises a different barcode sequence fragment.
124. The method of any one of clauses 91 to 118 wherein the nucleic acid construct is incorporated into the genome of a microorganism.
125. The method of any one of clauses 117 to 123 wherein the nucleic acid construct is incorporated into a plasmid.
126. The method of any one of clauses 90 to 111 or 119 to 124 wherein the library preparation step further comprises the step of hybridizing the nucleic acid construct to an immobilized probe before sequencing the nucleic acid construct.
127. The method of clause 126 wherein the probe comprises sequences complementary to the universal sequence fragments in the nucleic acid construct and wherein the probe does not hybridize to the barcode sequence fragment in the nucleic acid construct.
128. The method of any one of clauses 90 to 127 wherein detecting and quantifying the nucleic acid construct in total DNA comprises:
   a) identifying each universal sequence fragment in sequencing reads generated by sequencing the total DNA;
   b) identifying the barcode sequence fragment in each sequencing read identified as including a universal sequence fragment; and
   c) counting the number of occurrences of each unique barcode sequence fragment identified in the sequencing reads generated by sequencing the total DNA.
129. The method of clause 128, wherein the identifying steps are performed using a text-matching algorithm.
130. The method of clause 128 or 129 wherein identifying each universal sequence fragment comprises referencing a database of universal sequence fragments that may be included in the nucleic acid construct of the control composition.
131. The method of any one of clauses 128 to 130 wherein identifying the barcode sequence fragment comprises referencing a database of barcode sequence fragments that may be included in the nucleic acid construct of the control composition.
132. The method of any one of clauses 128 to 131 further comprising comparing the number of occurrences of each unique barcode sequence fragment identified in the sequencing reads generated by sequencing the total DNA to a known concentration of the nucleic acid construct comprising that barcode sequence fragment in the control composition that was used to spike the sample.

133. The method of any one of clauses 128 to 132 further comprising determining that cross-contamination or sample swapping has occurred in response to identifying an unexpected barcode sequence fragment in the sequencing reads generated by sequencing the total DNA.
134. The method of any one of clauses 128 to 133 further comprising identifying the GC content fragment in each sequencing read identified as including a universal sequence fragment and counting the number of occurrences of each unique GC content fragment identified in the sequencing reads generated by sequencing the total DNA.
135. The method of clause 134, further comprising comparing the number of occurrences of each unique GC content fragment identified in the sequencing reads generated by sequencing the total DNA to a known concentration of the nucleic acid construct comprising that GC content fragment in the control composition that was used to spike the sample.
136. A chemical analysis control composition, said control composition comprising a nucleic acid construct comprising at least one barcode sequence fragment linked at its 5' or 3' end to at least one universal sequence fragment.
137. The control composition of clause 136 wherein the control composition is used to determine if cross-contamination between samples for chemical analysis has occurred.
138. The control composition of clause 136 wherein the control composition is used to determine if sample swapping has occurred.
139. The control composition of any one of clauses 136 to 138 wherein the nucleic acid construct is a deoxyribonucleic acid construct.
140. The control composition of any one of clauses 136 to 139 wherein the nucleic acid construct comprises at least a first and a second universal sequence fragment.
141. The control composition of clause 140 wherein the first universal sequence fragment is linked to the 5' end of the barcode sequence fragment and the second universal sequence fragment is linked to the 3' end of the barcode sequence fragment.
142. The control composition of any one of clauses 136 to 141 wherein the nucleic acid construct further comprises at least a first and a second primer binding site fragment.
143. The control composition of clause 142 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
144. The control composition of clause 143 wherein the primer binding site fragments range in length from about 15 base pairs to about 30 base pairs.
145. The control composition of clause 143 wherein the nucleic acid construct ranges in length from about 80 base pairs to about 300 base pairs.
146. The control composition of any one of clauses 136 to 145 wherein the chemical analysis is quantitative and/or qualitative.

147. The control composition of any one of clauses 136 to 146 wherein a small molecule is analyzed and the small molecule is an inorganic compound or an organic compound.
148. The control composition of any one of clauses 136 to 147 wherein the chemical analysis is selected from the group consisting of forensic analysis, environmental analysis, industrial analysis, and medical analysis.
149. The control composition of clause 148 wherein the analysis is forensic analysis and the forensic analysis is selected from the group consisting of stomach content analysis, blood alcohol content analysis, substance abuse analysis, toxin analysis, and poison analysis.
150. The control composition of any one of clauses 136 to 149 wherein the chemical analysis is mass spectrometry.
151. The control composition of any one of clauses 136 to 150 wherein the nucleic acid construct is encapsulated.
152. The control composition of clause 151 wherein the nucleic acid construct is encapsulated in a liposome.
153. The control composition of clause 152 wherein the liposome comprises a lipid selected from the group consisting of cholesterol, a lipopolysaccharide, a peptidoglycan, a PEG, a teichoic acid, a phospholipid, and combinations thereof.
154. The control composition of any one of clauses 136 to 153 wherein the barcode sequence fragment comprises a unique sequence not present in any known genome.
155. The control composition of any one of clauses 136 to 154 wherein the nucleic acid construct is incorporated into a plasmid.
156. A kit comprising the control composition of any one of clauses 136 to 155.
157. The kit of clause 156 further comprising a reagent for nucleic acid extraction.
158. The kit of clause 156 or 157 further comprising a reagent for nucleic acid purification.
159. The kit of any one of clauses 156 to 158 further comprising a reagent for library preparation.
160. The kit of any one of clauses 156 to 159 further comprising a probe.
161. The kit of any one of clauses 156 to 160 further comprising a reagent for sequencing.
162. A method for monitoring cross-contamination or sample swapping during an analytical chemistry protocol, the method comprising,
  a) spiking an analytical chemistry protocol sample with a control composition comprising a nucleic acid construct wherein the nucleic acid construct comprises at least one barcode sequence fragment linked to at least one universal sequence fragment and wherein the nucleic acid construct is a deoxyribonucleic acid construct;
  b) performing the analytical chemistry protocol;
  c) archiving a sample from the analytical chemistry protocol;
  d) extracting total DNA from the archived sample wherein total DNA comprises the DNA from the nucleic acid construct and DNA from the analytical chemistry protocol sample, if any;
  e) purifying total DNA;
  f) preparing a library from total DNA;
  g) sequencing the extracted, purified total DNA; and
  h) detecting the nucleic acid construct in total DNA.
163. The method of clause 162 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.
164. The method of clause 162 or 163 wherein the method is used to determine if cross-contamination between samples has occurred.
165. The method of clause 162 or 163 wherein the method is used to determine if sample swapping has occurred.
166. The method of any one of clauses 162 to 165 wherein the step of preparing the library from total DNA comprises a step of amplifying the nucleic acid construct.
167. The method of any one of clauses 162 to 166 wherein the nucleic acid construct comprises at least a first and a second universal sequence fragment.
168. The method of clause 167 wherein the first universal sequence fragment is linked to the 5' end of the barcode sequence fragment and the second universal sequence fragment is linked to the 3' end of the barcode sequence fragment.
169. The method of any one of clauses 162 to 168 wherein the nucleic acid construct further comprises at least a first and a second primer binding site fragment.
170. The method of clause 169 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
171. The method of clause 170 wherein the primer binding site fragments range in length from about 15 base pairs to about 30 base pairs.
172. The method of clause 170 wherein the nucleic acid construct ranges in length from about 80 base pairs to about 300 base pairs.
173. The method of any one of clauses 162 to 172 wherein the nucleic acid construct is encapsulated.
174. The method of clause 173 wherein the nucleic acid construct is encapsulated in a liposome.
175. The method of clause 174 wherein the liposome comprises a lipid selected from the group consisting of cholesterol, a lipopolysaccharide, a peptidoglycan, a PEG, a teichoic acid, a phospholipid, and combinations thereof.
176. The method of any one of clauses 162 to 175 wherein the barcode sequence fragment comprises a unique sequence not present in any known genome.
177. The method of any one of clauses 162 to 176 wherein the nucleic acid construct is incorporated into a plasmid.
178. The method of any one of clauses 162 to 177 wherein the chemical analysis is quantitative and/or qualitative.
179. The method of any one of clauses 162 to 178 wherein a small molecule is analyzed and the small molecule is an inorganic compound or an organic compound.
180. The method of any one of clauses 162 to 179 wherein the chemical analysis is selected from the group consisting of forensic analysis, environmental analysis, industrial analysis, and medical analysis.

181. The method of clause 180 wherein the analysis is forensic analysis and the forensic analysis is selected from the group consisting of stomach content analysis, blood alcohol content analysis, substance abuse analysis, toxin analysis, and poison analysis, or combinations thereof.

182. The method of any one of clauses 162 to 180 wherein the analytical chemistry protocol is mass spectrometry.

183. The method of any one of clauses 162 to 182 wherein detecting the nucleic acid construct in total DNA comprises
   i) identifying the universal sequence fragment in a sequencing read generated by sequencing the extracted, purified total DNA;
   ii) comparing a sequence fragment adjacent the universal sequence fragment in the sequencing read to the barcode sequence fragment; and
   iii) determining that cross-contamination or sample swapping has occurred in response to the sequence fragment adjacent the universal sequence fragment not matching the barcode sequence fragment.

184. The method of any one of clauses 167 to 182 wherein detecting the nucleic acid construct in total DNA comprises
   iv) identifying the first and second universal sequence fragments in a sequencing read generated by sequencing the extracted, purified total DNA;
   v) comparing a sequence fragment located between the first and second universal sequence fragments in the sequencing read to the barcode sequence fragment; and
   vi) determining that cross-contamination or sample swapping has occurred in response to the sequence fragment located between the first and second universal sequence fragments not matching the barcode sequence fragment.

185. The method of clause 183 or 184, wherein the identifying and comparing steps are performed using a text-matching algorithm.

186. The method of any one of clauses 183 to 185 wherein the identifying step comprises referencing a database of universal sequence fragments that may be included in the nucleic acid construct of the control composition.

187. The method of any one of clauses 183 to 186 wherein the comparing step comprises referencing a database of barcode sequence fragments that may be included in the nucleic acid construct of the control composition.

BRIEF DESCRIPTION OF THE DRAWINGS

FIG. 4 shows the sequencing results for soil samples in which CCC-1 DNA and CCC-2 DNA were spiked-in prior to extraction either individually or where CCC-1 DNA and CCC-2 DNA were spiked-in together.

DETAILED DESCRIPTION OF ILLUSTRATIVE EMBODIMENTS

Figure 1:
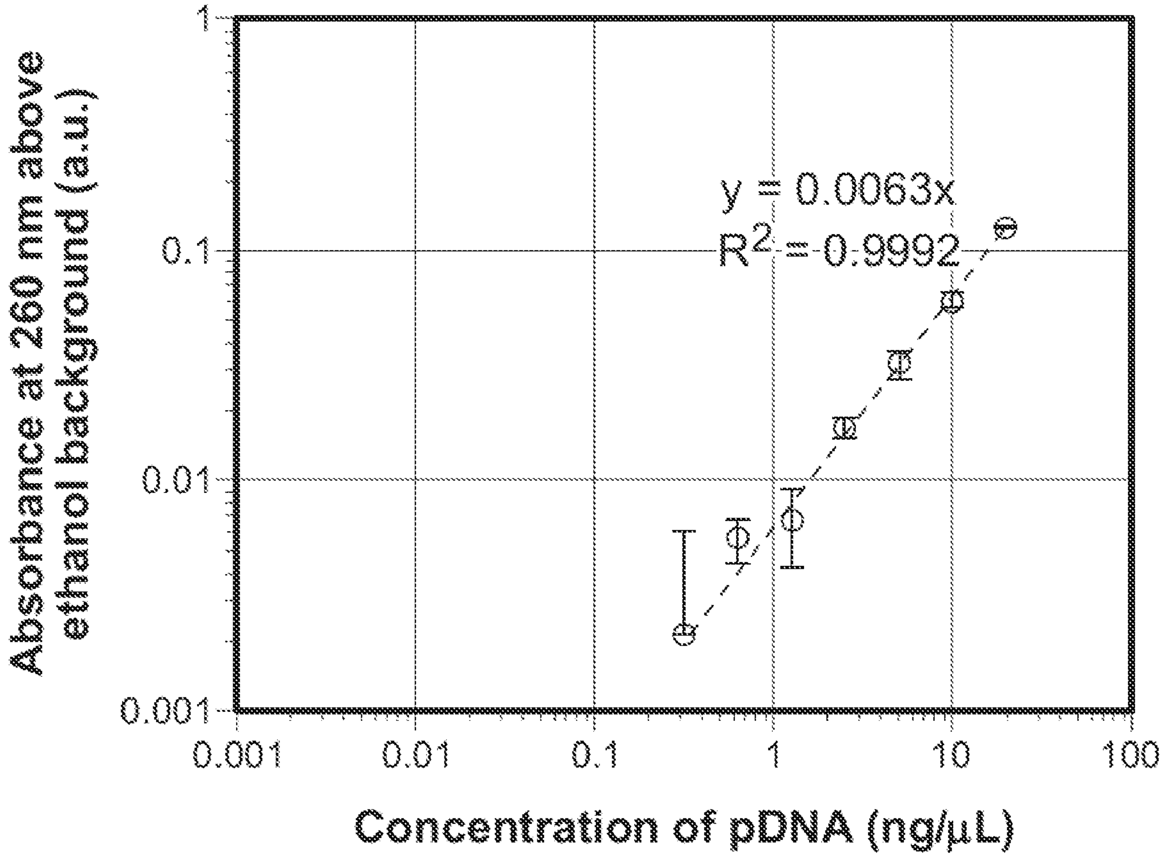
FIG. 1 shows the quantification of CCC DNA (i.e., CCC-1 DNA—for a description see Example 1) via UV absorbance at 260 nm. The curve is linear and CCC DNA (i.e., CCC-1 DNA) can be detected down to a concentration of about 0.3 ng/μL. The absorbance for the sample used in the assays corresponding to FIGS. 2A and B and FIG. 4 was 0.015±0.001. This corresponds to a concentration of ~12±1 ng/μL.

The present invention provides sequencing controls that can be used starting after the extraction step (e.g., by spiking the extract with the control constructs) or in every step of analysis of an unknown test sample (e.g., from nucleic acid extraction to nucleic acid purification to library preparation and sequencing). In one embodiment, nucleic acid constructs comprising a barcode sequence fragment are provided that can be encapsulated in a simulated cell membrane (e.g., a simulated bacterial cell membrane or eukaryotic cell membrane), or embedded directly in the genome of an organism for use as spike-in sequencing controls. In one aspect, the barcode sequence fragment comprises a unique sequence not present in any known genome. In one embodiment, the sequencing controls can be spiked in the unknown test sample prior to or after nucleic acid extraction and then can be detected in the final sequenced samples. In another embodiment, different nucleic acid constructs (i.e., with different barcode sequence fragments) can be spiked in different samples so that cross-contamination of samples or sample swapping can be detected.

In one embodiment, the barcode sequence fragment can be flanked at its 5' or 3' end, or both, by universal sequence fragments. The universal sequence fragments can add length to the nucleic acid construct and can serve as markers for bioinformatic analysis to identify the beginning and end of the barcode sequence fragment after sequencing. In another illustrative aspect, the barcode sequence fragment may be flanked by primer binding site sequence fragments (i.e., directly or indirectly linked to the barcode sequence fragment) so that the nucleic acid construct comprising the barcode sequence fragment can be amplified during an amplicon sequencing protocol. In another embodiment, primer binding site sequence fragments may be lacking for use of the sequencing controls in whole genome sequencing protocols. In another embodiment, a set of different nucleic acid construct spike-ins with different barcode sequence fragments (e.g., 384 or 96 different barcode sequence fragments) can be used to allow for multiplexing of samples on one sequencing run.

In various embodiments, samples with microorganisms containing nucleic acids (e.g., DNA), or samples with other sources of nucleic acids, may be analyzed by sequencing using the control compositions for sequencing described herein. The samples can be, for example, selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, hair, a tissue sample, a soil sample, a water sample, a food sample, an air sample, a plant sample, an industrial waste sample, a surface wipe sample, and an animal sample.

In another embodiment, compositions and methods are provided for the use of spike-in controls that simultaneously 1) control for cross-contamination and/or sample swapping and 2) allow for quantitation while controlling for different GC content samples (e.g., low, balanced, and high GC content) and/or for different lysis efficiencies. In one aspect, barcoded DNA molecules are produced with different GC contents, using GC content fragments, wherein barcode sequence fragments and GC content fragments are flanked by universal sequence fragments, and then the nucleic acid construct can be encapsulated in a simulated cell membrane. By using the same type of nucleic acid construct, but with different barcode sequence fragments, different quantities of the encapsulated or unencapsulated nucleic acid construct can be spiked-in, and a standard curve for quantitation can be produced. In this embodiment, the barcode sequence fragments can be used to verify that no cross-contamination or sample swapping occurred during sample preparation or processing. In this quantitation embodiment, the different GC content fragments (e.g., low, balanced, and high GC content) have the same barcode sequence fragment at each GC percentage (e.g., low, balanced, and high GC content), but at each separate concentration of the nucleic acid construct used to produce the standard curve, the barcode sequence fragments are unique to each concentration used to produce the standard curve. In this embodiment, the encapsulation method can also be varied to control for different resistances to lysis to mimic, for example, Gram-positive bacterial cell walls, Gram-negative bacterial cell walls, and fungal cell walls. In this encapsulation embodiment, the type of encapsulation method can be correlated to a unique barcode sequence fragment in the nucleic acid construct to enable differentiation post sequencing.

In one embodiment, the nucleic acid construct can be constructed (5' to 3') with a universal sequence fragment, a unique barcode sequence fragment, a GC content fragment (e.g., with high, balanced, or low GC content), and a second universal sequence fragment. In this embodiment, the unique barcode sequence fragment is a sequence that is not present in any known genome. An exemplary GC content fragment can contain about 60 to about 100 percent GC content for high GC content, about 40 to about 60 percent GC content for balanced GC content, and about 1 to about 40 percent GC content for low GC content. In this embodiment, the universal sequence fragments can add length to the nucleic acid construct and can serve as markers for bioinformatic analysis to identify the beginning and end of the nucleic acid construct after sequencing. In alternate embodiments, the universal sequence fragments could be extended as needed to make the total nucleic acid construct longer for different applications such as long read sequencing. In various embodiments, the nucleic acid constructs can either be encapsulated to spike into samples at sample collection and control for full sample preparation and processing or can be unencapsulated and can be spiked in after extraction to control for library preparation. In one aspect, two or more mixtures of three different GC content fragment constructs can be prepared (e.g., a low quantity standard and a high quantity standard with each having a unique barcode sequence fragment so that the high and low quantity standards can be differentiated post-sequencing).

In yet another embodiment, spike-in cross-contamination and sample swapping controls for analytical chemistry analysis of unknown materials are provided. These controls can be used in analytical chemistry procedures, such as mass spectrometry, and any of the nucleic acid constructs described herein can be used.

The following clauses, and combinations thereof, provide various additional illustrative aspects of the invention described herein. The various embodiments described in any other section of this patent application, including the summary portion of the section titled "BACKGROUND AND SUMMARY", the "EXAMPLES", and this "DETAILED DESCRIPTION OF ILLUSTRATIVE EMBODIMENTS" section of the application are applicable to any of the following embodiments of the invention described in the numbered clauses below.

1. A sequencing control composition, said control composition comprising a nucleic acid construct comprising at least one barcode sequence fragment linked at its 5' or 3' end to at least one universal sequence fragment.
2. The control composition of clause 1 wherein the control composition is used to determine if cross-contamination between samples for sequencing has occurred.
3. The control composition of clause 1 wherein the control composition is used to determine if sample swapping has occurred.
4. The control composition of any one of clauses 1 to 3 wherein the nucleic acid construct is a deoxyribonucleic acid construct.
5. The control composition of any one of clauses 1 to 4 wherein the nucleic acid construct comprises at least a first and a second universal sequence fragment.
6. The control composition of clause 5 wherein the first universal sequence fragment is linked to the 5' end of the barcode sequence fragment and the second universal sequence fragment is linked to the 3' end of the barcode sequence fragment.
7. The control composition of any one of clauses 1 to 6 wherein the nucleic acid construct further comprises at least a first and a second primer binding site fragment.
8. The control composition of clause 6 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
9. The control composition of clause 8 wherein the primer binding site fragments range in length from about 15 base pairs to about 30 base pairs.
10. The control composition of clause 8 wherein the nucleic acid construct ranges in length from about 80 base pairs to about 300 base pairs.
11. The control composition of any one of clauses 1 to 6 wherein the sequencing is whole genome sequencing.
12. The control composition of any one of clauses 7 to 10 wherein the sequencing is amplicon sequencing.
13. The control composition of any one of clauses 1 to 12 wherein the sequencing is Next Generation Sequencing.
14. The control composition of any one of clauses 1 to 13 wherein the nucleic acid construct is encapsulated.
15. The control composition of clause 14 wherein the nucleic acid construct is encapsulated in a liposome.
16. The control composition of clause 15 wherein the liposome comprises a lipid selected from the group consisting of cholesterol, a lipopolysaccharide, a peptidoglycan, a PEG, a teichoic acid, a phospholipid, and combinations thereof.
17. The control composition of any one of clauses 1 to 13 wherein the nucleic acid construct is incorporated into the genome of a microorganism.
18. The control composition of any one of clauses 1 to 17 wherein the barcode sequence fragment comprises a unique sequence not present in any known genome.
19. The control composition of any one of clauses 12 to 16 wherein the nucleic acid construct is incorporated into a plasmid.
20. A kit comprising the control composition of any one of clauses 1 to 19.
21. The kit of clause 20 further comprising a reagent for nucleic acid extraction.
22. The kit of clause 20 or 21 further comprising a reagent for nucleic acid purification.
23. The kit of any one of clauses 20 to 22 further comprising a reagent for library preparation.
24. The kit of any one of clauses 20 to 23 further comprising a probe.
25. The kit of any one of clauses 20 to 24 further comprising a reagent for sequencing.
26. The kit of any one of clauses 20 to 25 wherein the kit comprises more than one control composition of any one of clauses 1 to 19 wherein each control composition comprises a different nucleic acid construct wherein the different nucleic acid constructs comprise different barcode sequence fragments.
27. A method for monitoring cross-contamination or sample swapping over all steps of a DNA sequencing protocol including collection of a sample comprising DNA, DNA extraction from the sample, purification of the extracted DNA, library preparation, and sequencing, the method comprising,
   a) spiking the sample with a control composition comprising a nucleic acid construct wherein the nucleic acid construct comprises at least one barcode sequence fragment linked to at least one universal sequence fragment and wherein the nucleic acid construct is a deoxyribonucleic acid construct;

b) extracting total DNA wherein total DNA comprises the DNA from the sample and DNA from the nucleic acid construct;
c) purifying total DNA;
d) preparing a library from total DNA;
e) sequencing the extracted, purified total DNA; and
f) detecting the nucleic acid construct in total DNA.

28. The method of clause 27 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.
29. The method of clause 27 or 28 wherein the method is used to determine if cross-contamination between samples has occurred.
30. The method of clause 27 or 28 wherein the method is used to determine if sample swapping has occurred.
31. The method of any one of clauses 27 to 30 wherein the step of preparing the library from total DNA comprises a step of amplifying the nucleic acid construct.
32. The method of any one of clauses 27 to 31 wherein the nucleic acid construct comprises at least a first and a second universal sequence fragment.
33. The method of clause 32 wherein the first universal sequence fragment is linked to the 5' end of the barcode sequence fragment and the second universal sequence fragment is linked to the 3' end of the barcode sequence fragment.
34. The method of any one of clauses 27 to 33 wherein the nucleic acid construct further comprises at least a first and a second primer binding site fragment.
35. The method of clause 34 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
36. The method of clause 35 wherein the primer binding site fragments range in length from about 15 base pairs to about 30 base pairs.
37. The method of clause 35 wherein the nucleic acid construct ranges in length from about 80 base pairs to about 300 base pairs.
38. The method of any one of clauses 27 to 33 wherein the sequencing is whole genome sequencing.
39. The method of any one of clauses 34 to 37 wherein the sequencing is amplicon sequencing.
40. The method of any one of clauses 27 to 39 wherein the sequencing is Next Generation Sequencing.
41. The method of any one of clauses 27 to 40 wherein the nucleic acid construct is encapsulated.
42. The method of clause 41 wherein the nucleic acid construct is encapsulated in a liposome.
43. The method of clause 42 wherein the liposome comprises a lipid selected from the group consisting of cholesterol, a lipopolysaccharide, a peptidoglycan, a PEG, a teichoic acid, a phospholipid, and combinations thereof.
44. The method of any one of clauses 27 to 40 wherein the nucleic acid construct is incorporated into the genome of a microorganism.
45. The method of any one of clauses 27 to 44 wherein the barcode sequence fragment comprises a unique sequence not present in any known genome.
46. The method of any one of clauses 39 to 43 wherein the nucleic acid construct is incorporated into a plasmid.
47. The method of any one of clauses 26 to 33 or 41 to 45 wherein the library preparation step further comprises the step of hybridizing the nucleic acid construct to an immobilized probe before sequencing the nucleic acid construct.
48. The method of clause 47 wherein the probe comprises sequences complementary to the universal sequence fragments in the nucleic acid construct and wherein the probe does not hybridize to the barcode sequence fragment in the nucleic acid construct.
49. The method of any one of clauses 27 to 48 wherein detecting the nucleic acid construct in total DNA comprises
iv) identifying the universal sequence fragment in a sequencing read generated by sequencing the extracted, purified total DNA;
v) comparing a sequence fragment adjacent the universal sequence fragment in the sequencing read to the barcode sequence fragment; and
vi) determining that cross-contamination or sample swapping has occurred in response to the sequence fragment adjacent the universal sequence fragment not matching the barcode sequence fragment.
50. The method of any one of clauses 32 to 48 wherein detecting the nucleic acid construct in total DNA comprises
vii) identifying the first and second universal sequence fragments in a sequencing read generated by sequencing the extracted, purified total DNA;
viii) comparing a sequence fragment located between the first and second universal sequence fragments in the sequencing read to the barcode sequence fragment; and
ix) determining that cross-contamination or sample swapping has occurred in response to the sequence fragment located between the first and second universal sequence fragments not matching the barcode sequence fragment.
51. The method of clause 49 or 50, wherein the identifying and comparing steps are performed using a text-matching algorithm.
52. The method of any one of clauses 49 to 51 wherein the identifying step comprises referencing a database of universal sequence fragments that may be included in the nucleic acid construct of the control composition.
53. The method of any one of clauses 49 to 52 wherein the comparing step comprises referencing a database of barcode sequence fragments that may be included in the nucleic acid construct of the control composition.
54. A sequencing control composition, said control composition comprising a nucleic acid construct comprising at least one barcode sequence fragment, at least one universal sequence fragment, and at least one GC content fragment.

55. The control composition of clause 54 wherein one or more of the GC content fragments has a GC content of about 1 to about 40 percent.
56. The control composition of clause 54 wherein one or more of the GC content fragments has a GC content of about 40 to about 60 percent.
57. The control composition of clause 54 wherein one or more of the GC content fragments has a GC content of about 60 to about 100 percent.
58. The control composition of any one of clauses 54 to 57 comprising nucleic acid constructs with GC content fragments with at least two different percent GC contents.
59. The control composition of any one of clauses 54 to 58 comprising nucleic acid constructs with GC content fragments with at least three different percent GC contents.
60. The control composition of any one of clauses 54 to 59 comprising nucleic acid constructs with GC content fragments with at least four different percent GC contents.
61. The control composition of clause 59 wherein the percent GC contents are about 1 to about 40 percent, about 40 percent to about 60 percent, and about 60 percent to about 100 percent.
62. The control composition of any one of clauses 54 to 61 wherein the control composition is used to determine if cross-contamination between samples for sequencing has occurred.
63. The control composition of any one of clauses 54 to 62 wherein the control composition is used to determine if sample swapping has occurred.
64. The control composition of any one of clauses 54 to 63 wherein the GC content fragment is used to control for polymerase, transposase, ligase, or repair enzyme GC content bias.
65. The control composition of any one of clauses 54 to 64 wherein the control composition is used for quantification of nucleic acids during sequencing.
66. The control composition of any one of clauses 54 to 65 wherein the nucleic acid construct is a deoxyribonucleic acid construct.
67. The control composition of any one of clauses 54 to 66 wherein the nucleic acid construct comprises at least a first and a second universal sequence fragment.
68. The control composition of clause 67 wherein the first universal sequence fragment is linked to the 5' end of the barcode sequence fragment, the barcode sequence fragment is between the first universal sequence fragment and the GC content fragment, and the second universal sequence fragment is linked to the 3' end of the GC content fragment.
69. The control composition of any one of clauses 67 to 68 wherein the nucleic acid construct further comprises at least a first and a second primer binding site fragment.
70. The control composition of clause 69 wherein the first primer binding site fragment is linked at its 3' end to the 5' end of the first universal sequence fragment and the second primer binding site fragment is linked at its 5' end to the 3' end of the second universal sequence fragment.
71. The control composition of any one of clauses 69 to 70 wherein the primer binding site fragments range in length from about 15 base pairs to about 30 base pairs.
72. The control composition of any one of clauses 54 to 71 wherein the nucleic acid construct ranges in length from about 80 base pairs to about 300 base pairs.
73. The control composition of any one of clauses 54 to 68 wherein the sequencing is whole genome sequencing.
74. The control composition of any one of clauses 69 to 72 wherein the sequencing is amplicon sequencing.
75. The control composition of any one of clauses 54 to 74 wherein the sequencing is Next Generation Sequencing.
76. The control composition of any one of clauses 54 to 75 wherein the nucleic acid construct is encapsulated.
77. The control composition of clause 76 wherein the nucleic acid construct is encapsulated in a liposome.
78. The control composition of clause 77 wherein the liposome comprises a lipid selected from the group consisting of cholesterol, a lipopolysaccharide, a peptidoglycan, a PEG, a teichoic acid, a phospholipid, and combinations thereof.
79. The control composition of any one of clauses 54 to 78 wherein the barcode sequence fragment comprises a unique sequence not present in any known genome.
80. The control composition of any one of clauses 54 to 75 wherein the nucleic acid construct is incorporated into the genome of a microorganism.
81. The control composition of any one of clauses 74 to 79 wherein the nucleic acid construct is incorporated into a plasmid.
82. A kit comprising the control composition of any one of clauses 54 to 81.
83. The kit of clause 82 further comprising a reagent for nucleic acid extraction.
84. The kit of clause 82 or 83 further comprising a reagent for nucleic acid purification.
85. The kit of any one of clauses 82 to 84 further comprising a reagent for library preparation.
86. The kit of any one of clauses 82 to 85 further comprising a probe.
87. The kit of any one of clauses 82 to 86 further comprising a reagent for sequencing.
88. The kit of any one of clauses 82 to 87 wherein the kit comprises more than one control composition of any one of clauses 54 to 81 wherein each control composition comprises a different nucleic acid construct wherein the different nucleic acid constructs comprise different barcode sequence fragments.
89. The kit of any one of clauses 82 to 88 wherein the kit comprises more than one control composition of any one of clauses 54 to 81 and wherein the nucleic acid construct in each control composition is encapsulated in a different type of liposome.
90. A method for monitoring sample cross-contamination and/or sample swapping and for quantification of nucleic acids during sequencing, the method comprising,
a) extracting DNA from a sample;
b) purifying the DNA;
c) spiking the sample, after DNA extraction and purification and before library preparation, with a control composition comprising a nucleic acid construct wherein the nucleic acid construct comprises at least one barcode sequence fragment, at least one universal sequence fragment, and at least one GC content fragment, and wherein the nucleic acid construct is a deoxyribonucleic acid construct, wherein total DNA is obtained after spiking the sample, and wherein total DNA comprises the DNA from the sample and the DNA from the nucleic acid construct;

d) preparing a library from total DNA;

e) sequencing total DNA; and f) detecting and quantifying the nucleic acid construct in total DNA.

91. A method for monitoring sample cross-contamination and/or sample swapping and for quantification of nucleic acids during sequencing, the method comprising, a) spiking a sample with a control composition comprising a nucleic acid construct wherein the nucleic acid construct comprises at least one barcode sequence fragment, at least one universal sequence fragment, and at least one GC content fragment and wherein the nucleic acid construct is a deoxyribonucleic acid construct;

b) extracting total DNA from the sample wherein total DNA comprises the DNA from the sample and the DNA from the nucleic acid construct;

c) purifying total DNA;

d) preparing a library from total DNA;

e) sequencing total DNA; and f) detecting and quantifying the nucleic acid construct in total DNA.

92. The method of clause 91 wherein sample cross-contamination and/or sample swapping can be monitored over all steps of a DNA sequencing protocol including collection of the sample, extraction of total DNA, purification of the extracted total DNA, library preparation, and sequencing.

93. The method of any one of clauses 90 to 92 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.

94. The method of any one of clauses 90 to 93 wherein the step of preparing the library from total DNA comprises a step of amplifying the nucleic acid construct.

95. The method of any one of clauses 90 to 94 wherein one of the GC content fragments has a GC content of about 1 to about 40 percent.

96. The method of any one of clauses 90 to 94 wherein one of the GC content fragments has a GC content of about 40 to about 60 percent.

97. The method of any one of clauses 90 to 94 wherein one of the GC content fragments has a GC content of about 60 to about 100 percent.

98. The method of any one of clauses 90 to 97 wherein the control composition comprises nucleic acid constructs with GC content fragments with at least two different percent GC contents.

99. The method of any one of clauses 90 to 98 wherein the control composition comprises nucleic acid constructs with GC content fragments with at least three different percent GC contents.

100. The method of any one of clauses 90 to 99 wherein the control composition comprises nucleic acid constructs with GC content fragments with at least four different percent GC contents.

101. The method of clause 99 wherein the GC contents are about 1 to about 40 percent, about 40 percent to about 60 percent, and about 60 percent to about 100 percent.

102. The method of any one of clauses 90 to 101 wherein the GC content fragment is used to control for polymerase, transposase, ligase, or repair enzyme GC content bias.

103. The method of any one of clauses 90 to 102 wherein the nucleic acid construct is present at at least two different concentrations for use in generating a standard curve for the quantification of nucleic acids during sequencing.

104. The method of any one of clauses 90 to 103 wherein the nucleic acid construct is present at at least three different concentrations for use in generating a standard curve for the quantification of nucleic acids during sequencing.

105. The method of any one of clauses 90 to 104 wherein the nucleic acid construct is present at at least four different concentrations for use in generating a standard curve for the quantification of nucleic acids during sequencing.

106. The method of any one of clauses 90 to 105 wherein the nucleic acid construct is present at at least five different concentrations for use in generating a standard curve for the quantification of nucleic acids during sequencing.

107. The method of any one of clauses 103 to 106 wherein a different bar code sequence fragment is present in the nucleic acid construct at each of the different concentrations of the nucleic acid construct.

108. The method of clause 107 wherein at each of the different concentrations of the nucleic construct, the control composition comprises multiple nucleic acid constructs with different percent GC contents but with the same barcode sequence fragment for the nucleic acid constructs with different percent GC contents.

109. The method of any one of clauses 90 to 108 wherein the barcode sequence fragment comprises a unique sequence not present in any known genome.

110. The method of any one of clauses 90 to 109 wherein the nucleic acid construct comprises at least a first and a second universal sequence fragment.

111. The method of clause 110 wherein the first universal sequence fragment is linked to the 5' end of the barcode sequence fragment, the barcode sequence fragment is between the first universal sequence fragment and the GC content fragment, and the second universal sequence fragment is linked to the 3' end of the GC content fragment.

112. The method of any one of clauses 109 to 111 wherein the nucleic acid construct further comprises at least a first and a second primer binding site fragment.

113. The method of clause 112 wherein the first primer binding site fragment is linked at its 3' end to the 5' end of the first universal sequence fragment and the second primer binding site fragment is linked at its 5' end to the 3' end of the second universal sequence fragment.

114. The method of any one of clauses 112 to 113 wherein the primer binding site fragments range in length from about 15 base pairs to about 30 base pairs.

115. The method of any one of clauses 90 to 114 wherein the nucleic acid construct ranges in length from about 80 base pairs to about 300 base pairs.

116. The method of any one of clauses 90 to 111 wherein the sequencing is whole genome sequencing.
117. The method of any one of clauses 112 to 115 wherein the sequencing is amplicon sequencing.
118. The method of any one of clauses 90 to 117 wherein the sequencing is Next Generation Sequencing.
119. The method of any one of clauses 91 to 118 wherein the nucleic acid construct is encapsulated.
120. The method of clause 119 wherein the nucleic acid construct is encapsulated in a liposome.
121. The method of clause 120 wherein the liposome comprises a lipid selected from the group consisting of cholesterol, a lipopolysaccharide, a peptidoglycan, a PEG, a teichoic acid, a phospholipid, and combinations thereof.
122. The method of any one of clauses 119 to 121 wherein more than one type of control composition is used in the method wherein the nucleic acid construct in each type of control composition is encapsulated in a different type of liposome.
123. The method of clause 122 wherein each type of control composition with the nucleic acid construct encapsulated in a different type of liposome comprises a different barcode sequence fragment.
124. The method of any one of clauses 91 to 118 wherein the nucleic acid construct is incorporated into the genome of a microorganism.
125. The method of any one of clauses 117 to 123 wherein the nucleic acid construct is incorporated into a plasmid.
126. The method of any one of clauses 90 to 111 or 119 to 124 wherein the library preparation step further comprises the step of hybridizing the nucleic acid construct to an immobilized probe before sequencing the nucleic acid construct.
127. The method of clause 126 wherein the probe comprises sequences complementary to the universal sequence fragments in the nucleic acid construct and wherein the probe does not hybridize to the barcode sequence fragment in the nucleic acid construct.
128. The method of any one of clauses 90 to 127 wherein detecting and quantifying the nucleic acid construct in total DNA comprises:
   a) identifying each universal sequence fragment in sequencing reads generated by sequencing the total DNA;
   b) identifying the barcode sequence fragment in each sequencing read identified as including a universal sequence fragment; and
   c) counting the number of occurrences of each unique barcode sequence fragment identified in the sequencing reads generated by sequencing the total DNA.
129. The method of clause 128, wherein the identifying steps are performed using a text-matching algorithm.
130. The method of clause 128 or 129 wherein identifying each universal sequence fragment comprises referencing a database of universal sequence fragments that may be included in the nucleic acid construct of the control composition.
131. The method of any one of clauses 128 to 130 wherein identifying the barcode sequence fragment comprises referencing a database of barcode sequence fragments that may be included in the nucleic acid construct of the control composition.
132. The method of any one of clauses 128 to 131 further comprising comparing the number of occurrences of each unique barcode sequence fragment identified in the sequencing reads generated by sequencing the total DNA to a known concentration of the nucleic acid construct comprising that barcode sequence fragment in the control composition that was used to spike the sample.
133. The method of any one of clauses 128 to 132 further comprising determining that cross-contamination or sample swapping has occurred in response to identifying an unexpected barcode sequence fragment in the sequencing reads generated by sequencing the total DNA.
134. The method of any one of clauses 128 to 133 further comprising identifying the GC content fragment in each sequencing read identified as including a universal sequence fragment and counting the number of occurrences of each unique GC content fragment identified in the sequencing reads generated by sequencing the total DNA.
135. The method of clause 134, further comprising comparing the number of occurrences of each unique GC content fragment identified in the sequencing reads generated by sequencing the total DNA to a known concentration of the nucleic acid construct comprising that GC content fragment in the control composition that was used to spike the sample.
136. A chemical analysis control composition, said control composition comprising a nucleic acid construct comprising at least one barcode sequence fragment linked at its 5' or 3' end to at least one universal sequence fragment.
137. The control composition of clause 136 wherein the control composition is used to determine if cross-contamination between samples for chemical analysis has occurred.
138. The control composition of clause 136 wherein the control composition is used to determine if sample swapping has occurred.
139. The control composition of any one of clauses 136 to 138 wherein the nucleic acid construct is a deoxyribonucleic acid construct.
140. The control composition of any one of clauses 136 to 139 wherein the nucleic acid construct comprises at least a first and a second universal sequence fragment.
141. The control composition of clause 140 wherein the first universal sequence fragment is linked to the 5' end of the barcode sequence fragment and the second universal sequence fragment is linked to the 3' end of the barcode sequence fragment.
142. The control composition of any one of clauses 136 to 141 wherein the nucleic acid construct further comprises at least a first and a second primer binding site fragment.
143. The control composition of clause 142 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
144. The control composition of clause 143 wherein the primer binding site fragments range in length from about 15 base pairs to about 30 base pairs.
145. The control composition of clause 143 wherein the nucleic acid construct ranges in length from about 80 base pairs to about 300 base pairs.

146. The control composition of any one of clauses 136 to 145 wherein the chemical analysis is quantitative and/or qualitative.
147. The control composition of any one of clauses 136 to 146 wherein a small molecule is analyzed and the small molecule is an inorganic compound or an organic compound.
148. The control composition of any one of clauses 136 to 147 wherein the chemical analysis is selected from the group consisting of forensic analysis, environmental analysis, industrial analysis, and medical analysis.
149. The control composition of clause 148 wherein the analysis is forensic analysis and the forensic analysis is selected from the group consisting of stomach content analysis, blood alcohol content analysis, substance abuse analysis, toxin analysis, and poison analysis.
150. The control composition of any one of clauses 136 to 149 wherein the chemical analysis is mass spectrometry.
151. The control composition of any one of clauses 136 to 150 wherein the nucleic acid construct is encapsulated.
152. The control composition of clause 151 wherein the nucleic acid construct is encapsulated in a liposome.
153. The control composition of clause 152 wherein the liposome comprises a lipid selected from the group consisting of cholesterol, a lipopolysaccharide, a peptidoglycan, a PEG, a teichoic acid, a phospholipid, and combinations thereof.
154. The control composition of any one of clauses 136 to 153 wherein the barcode sequence fragment comprises a unique sequence not present in any known genome.
155. The control composition of any one of clauses 136 to 154 wherein the nucleic acid construct is incorporated into a plasmid.
156. A kit comprising the control composition of any one of clauses 136 to 155.
157. The kit of clause 156 further comprising a reagent for nucleic acid extraction.
158. The kit of clause 156 or 157 further comprising a reagent for nucleic acid purification.
159. The kit of any one of clauses 156 to 158 further comprising a reagent for library preparation.
160. The kit of any one of clauses 156 to 159 further comprising a probe.
161. The kit of any one of clauses 156 to 160 further comprising a reagent for sequencing.
162. A method for monitoring cross-contamination or sample swapping during an analytical chemistry protocol, the method comprising,
   a) spiking an analytical chemistry protocol sample with a control composition comprising a nucleic acid construct wherein the nucleic acid construct comprises at least one barcode sequence fragment linked to at least one universal sequence fragment and wherein the nucleic acid construct is a deoxyribonucleic acid construct;
   b) performing the analytical chemistry protocol;
   c) archiving a sample from the analytical chemistry protocol;
   d) extracting total DNA from the archived sample wherein total DNA comprises the DNA from the nucleic acid construct and DNA from the analytical chemistry protocol sample, if any;
   e) purifying total DNA;
   f) preparing a library from total DNA;
   g) sequencing the extracted, purified total DNA; and
   h) detecting the nucleic acid construct in total DNA.
163. The method of clause 162 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.
164. The method of clause 162 or 163 wherein the method is used to determine if cross-contamination between samples has occurred.
165. The method of clause 162 or 163 wherein the method is used to determine if sample swapping has occurred.
166. The method of any one of clauses 162 to 165 wherein the step of preparing the library from total DNA comprises a step of amplifying the nucleic acid construct.
167. The method of any one of clauses 162 to 166 wherein the nucleic acid construct comprises at least a first and a second universal sequence fragment.
168. The method of clause 167 wherein the first universal sequence fragment is linked to the 5' end of the barcode sequence fragment and the second universal sequence fragment is linked to the 3' end of the barcode sequence fragment.
169. The method of any one of clauses 162 to 168 wherein the nucleic acid construct further comprises at least a first and a second primer binding site fragment.
170. The method of clause 169 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
171. The method of clause 170 wherein the primer binding site fragments range in length from about 15 base pairs to about 30 base pairs.
172. The method of clause 170 wherein the nucleic acid construct ranges in length from about 80 base pairs to about 300 base pairs.
173. The method of any one of clauses 162 to 172 wherein the nucleic acid construct is encapsulated.
174. The method of clause 173 wherein the nucleic acid construct is encapsulated in a liposome.
175. The method of clause 174 wherein the liposome comprises a lipid selected from the group consisting of cholesterol, a lipopolysaccharide, a peptidoglycan, a PEG, a teichoic acid, a phospholipid, and combinations thereof.
176. The method of any one of clauses 162 to 175 wherein the barcode sequence fragment comprises a unique sequence not present in any known genome.
177. The method of any one of clauses 162 to 176 wherein the nucleic acid construct is incorporated into a plasmid.
178. The method of any one of clauses 162 to 177 wherein the chemical analysis is quantitative and/or qualitative.
179. The method of any one of clauses 162 to 178 wherein a small molecule is analyzed and the small molecule is an inorganic compound or an organic compound.

180. The method of any one of clauses 162 to 179 wherein the chemical analysis is selected from the group consisting of forensic analysis, environmental analysis, industrial analysis, and medical analysis.

181. The method of clause 180 wherein the analysis is forensic analysis and the forensic analysis is selected from the group consisting of stomach content analysis, blood alcohol content analysis, substance abuse analysis, toxin analysis, and poison analysis, or combinations thereof.

182. The method of any one of clauses 162 to 180 wherein the analytical chemistry protocol is mass spectrometry.

183. The method of any one of clauses 162 to 182 wherein detecting the nucleic acid construct in total DNA comprises iv) identifying the universal sequence fragment in a sequencing read generated by sequencing the extracted, purified total DNA;

v) comparing a sequence fragment adjacent the universal sequence fragment in the sequencing read to the barcode sequence fragment; and vi) determining that cross-contamination or sample swapping has occurred in response to the sequence fragment adjacent the universal sequence fragment not matching the barcode sequence fragment.

184. The method of any one of clauses 167 to 182 wherein detecting the nucleic acid construct in total DNA comprises x) identifying the first and second universal sequence fragments in a sequencing read generated by sequencing the extracted, purified total DNA;

xi) comparing a sequence fragment located between the first and second universal sequence fragments in the sequencing read to the barcode sequence fragment; and xii) determining that cross-contamination or sample swapping has occurred in response to the sequence fragment located between the first and second universal sequence fragments not matching the barcode sequence fragment.

185. The method of clause 183 or 184, wherein the identifying and comparing steps are performed using a text-matching algorithm.

186. The method of any one of clauses 183 to 185 wherein the identifying step comprises referencing a database of universal sequence fragments that may be included in the nucleic acid construct of the control composition.

187. The method of any one of clauses 183 to 186 wherein the comparing step comprises referencing a database of barcode sequence fragments that may be included in the nucleic acid construct of the control composition.

Control compositions for sequencing or chemical analyses and methods of their use are provided herein. The polymerase chain reaction (PCR) has been developed to analyze nucleic acids in a laboratory. PCR evolved over the last decade into a new generation of devices and methods known as Next Generation Sequencing (NGS). NGS provides faster detection and amplification of nucleic acids at a cheaper price. The NGS devices and methods allow for rapid sequencing as the nucleic acids are amplified in massively parallel, high-throughput platforms.

NGS, and other sequencing methods, for detection of nucleic acids are powerful techniques, for example, for pathogen detection and identification purposes, including for biosurveillance. However, the field suffers from a lack of standards for use in sequencing methods and devices, including NGS methods and devices. Currently, researchers are able to detect and identify nucleic acids from, for example, pathogens through sequencing, but are unable to monitor sample cross-contamination and sample swapping throughout the sequencing protocol. More effective standards are also needed for monitoring sample cross-contamination and sample swapping after the extraction process, and for quantitation of nucleic acids during sequencing.

Analytical chemistry analysis of unknown materials can be confounded by identification of compounds that do not seem to fit with what is expected. These unexpected compounds could be the result of a cross contamination event or may actually be present in the sample. Therefore, spike-in cross contamination and sample swapping controls are also needed for analytical chemistry analyses.

In one embodiment, control compositions for sequencing or chemical analyses are provided. The control compositions comprise a nucleic acid construct comprising at least one barcode sequence fragment. The barcode sequence fragment comprises a unique sequence not found in any known genome. In one embodiment, the control composition is used to determine if cross-contamination between samples for sequencing or chemical analyses has occurred. In another embodiment, the control composition is used to determine if sample swapping has occurred. In yet another embodiment, the control composition can be used for quantitation of nucleic acids during sequencing. In one aspect, the nucleic acid construct is a deoxyribonucleic acid construct. In another aspect, the nucleic acid construct is a ribonucleic acid. In another embodiment, the nucleic acid construct is incorporated into a plasmid.

In various embodiments, the barcode sequence fragment can be from about 10 to about 35 base pairs in length, about 10 to about 34 base pairs in length, about 10 to about 33 base pairs in length, about 10 to about 32 base pairs in length, about 10 to about 31 base pairs in length, about 10 to about 30 base pairs in length, about 10 to about 29 base pairs in length, about 10 to about 28 base pairs in length, about 10 to about 27 base pairs in length, about 10 to about 26 base pairs in length, about 10 to about 25 base pairs in length, about 10 to about 24 base pairs in length, about 10 to about 15 base pairs in length, about 21 to about 28 base pairs in length, about 21 to about 27 base pairs in length, about 21 to about 26 base pairs in length, about 21 to about 25 base pairs in length, about 22 to about 28 base pairs in length, about 22 to about 27 base pairs in length, about 22 to about 26 base pairs in length, about 22 to about 25 base pairs in length, about 23 to 25 base pairs in length, or about 24 base pairs in length.

Various embodiments of barcode sequence fragments are shown below in Table 1 (labeled barcode sequence fragments). These barcode sequence fragments can be used alone or in combinations of, for example, two or more barcode sequence fragments. Additional barcode sequence fragments are shown in Table 2 between the bolded fragments and within the exemplary nucleic acid constructs having SEQ ID NOS: 1 to 384.

TABLE 1

(SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TGGTCAACGATA (SEQ ID NO: 775) | CATCGCGTTGAC (SEQ ID NO: 776) | ACGTAACCACGT (SEQ ID NO: 777) | CTTCTTCGCCCT (SEQ ID NO: 778) | GACGGCTATGTT (SEQ ID NO: 779) | GTCATTGGGCTA (SEQ ID NO: 780) |
| ATCGCACAGTAA (SEQ ID NO: 781) | GCACATAGTCGT (SEQ ID NO: 782) | GTCGGAAATTGT (SEQ ID NO: 783) | CAGGCATAACAT (SEQ ID NO: 784) | TCTCTTTCGACA (SEQ ID NO: 785) | AGAGACGCGTAG (SEQ ID NO: 786) |
| GTCGTGTAGCCT (SEQ ID NO: 787) | GGCAAATACACT (SEQ ID NO: 788) | TCTAACGAGTGC (SEQ ID NO: 789) | ATGTGGCGTGTT (SEQ ID NO: 790) | GATTAGGTTCCG (SEQ ID NO: 791) | TTAATGGATCGG (SEQ ID NO: 792) |
| AGCGGAGGTTAG (SEQ ID NO: 793) | GTCATGCTCCAG (SEQ ID NO: 794) | CATCTGGGCAAT (SEQ ID NO: 795) | GTGCGGTTCACT (SEQ ID NO: 796) | CTACTCCACGAG (SEQ ID NO: 797) | ATATTGGCAGCC (SEQ ID NO: 798) |
| ATCCTTTGGTTC (SEQ ID NO: 799) | CCTAGTAAGCTG (SEQ ID NO: 800) | TGTCCGTGGATC (SEQ ID NO: 801) | CCTCACTAGCGA (SEQ ID NO: 802) | GGTGCAGACAGA (SEQ ID NO: 803) | TCGCATGGATAC (SEQ ID NO: 804) |
| TACAGCGCATAC (SEQ ID NO: 805) | TTACCGACGAGT (SEQ ID NO: 806) | ACTCGGCCAACT (SEQ ID NO: 807) | AGCTGATAGTTG (SEQ ID NO: 808) | CCGTACCGTATG (SEQ ID NO: 809) | CAACAATGCCAA (SEQ ID NO: 810) |
| ACCGGTATGTAC (SEQ ID NO: 811) | GCTTAGATGTAG (SEQ ID NO: 812) | GTTGGTTGGCAT (SEQ ID NO: 813) | GCTCTAGTAACG (SEQ ID NO: 814) | ATGTCCGACCAA (SEQ ID NO: 815) | GCCCGACATATA (SEQ ID NO: 816) |
| AATTGTGTCGGA (SEQ ID NO: 817) | AAGACGTAGCGG (SEQ ID NO: 818) | TTCCACACGTGG (SEQ ID NO: 819) | TGGTCCTACAAG (SEQ ID NO: 820) | AGATGGGACTGG (SEQ ID NO: 821) | GATTGAACGCTA (SEQ ID NO: 822) |
| TGCATACACTGG (SEQ ID NO: 823) | TTACCTTACACC (SEQ ID NO: 824) | AACCCAGATGAT (SEQ ID NO: 825) | CGCTATCCAGAC (SEQ ID NO: 826) | GTGCCCACTTGA (SEQ ID NO: 827) | AGTATTCGCGCA (SEQ ID NO: 828) |
| AGTCGAACGAGG (SEQ ID NO: 829) | TGACTAATGGCC (SEQ ID NO: 830) | GTAGTGTCAACA (SEQ ID NO: 831) | GCTTACGTAGGT (SEQ ID NO: 832) | ACCGAACAATCC (SEQ ID NO: 833) | TGCCAACAACAA (SEQ ID NO: 834) |
| ACCAGTGACTCA (SEQ ID NO: 835) | CTCTCTCACTTG (SEQ ID NO: 836) | TGGAGAGGAGAT (SEQ ID NO: 837) | AGTTGGTTACGA (SEQ ID NO: 838) | GTCTACCACGCA (SEQ ID NO: 839) | CTAAAGTAGCAC (SEQ ID NO: 840) |
| GAATACCAAGTC (SEQ ID NO: 841) | ATTGCAAGCAAC (SEQ ID NO: 842) | CGTATAAATGCG (SEQ ID NO: 843) | CTCTACGAACAG (SEQ ID NO: 844) | TCGCGTCCAGTA (SEQ ID NO: 845) | AGTGCTAGGTTA (SEQ ID NO: 846) |
| GTAGATCGTGTA (SEQ ID NO: 847) | CACGTGACATGT (SEQ ID NO: 848) | AATACAGACCTG (SEQ ID NO: 849) | CCTGTGTTGGTG (SEQ ID NO: 850) | GCCTGATTAAGC (SEQ ID NO: 851) | CGGAAACTCCAT (SEQ ID NO: 852) |
| TAACGTGTGTGC (SEQ ID NO: 853) | CACAGTTGAAGT (SEQ ID NO: 854) | GACTCAACCAGT (SEQ ID NO: 855) | GATGGGAGGACT (SEQ ID NO: 856) | ACGTATTCGAAG (SEQ ID NO: 857) | AGGAAAGCCAGA (SEQ ID NO: 858) |
| CATTATGGCGTG (SEQ ID NO: 859) | CTAGGATCACTG (SEQ ID NO: 860) | GGAAGAAGTAGC (SEQ ID NO: 861) | CAGAATCGCTCA (SEQ ID NO: 862) | CGGCTACTATGC (SEQ ID NO: 863) | GTCTGACGGTCT (SEQ ID NO: 864) |
| CCAATACGCCTG (SEQ ID NO: 865) | GATGACCCAAAT (SEQ ID NO: 866) | ATCGATCCACAG (SEQ ID NO: 867) | TGGCACTGGTTA (SEQ ID NO: 868) | AGTTCGGCATTG (SEQ ID NO: 869) | GAAACCAAGCTT (SEQ ID NO: 870) |
| GATCTGCGATCC (SEQ ID NO: 871) | ACCGGAGTAGGA (SEQ ID NO: 872) | ACACCGCACAAT (SEQ ID NO: 873) | GGCAGTGTTAAT (SEQ ID NO: 874) | TTGGGAGCGAAG (SEQ ID NO: 875) | TCATCACGGGCT (SEQ ID NO: 876) |
| CAGCTCATCAGC (SEQ ID NO: 877) | TGAGGACTACCT (SEQ ID NO: 878) | GTCTCCTCCCTT (SEQ ID NO: 879) | AACCCGTCGTCA (SEQ ID NO: 880) | TGTTCGCCCAGA (SEQ ID NO: 881) | TGTTCTGAGACG (SEQ ID NO: 882) |
| CAAACAACAGCT (SEQ ID NO: 883) | CAATCGGCTTGC (SEQ ID NO: 884) | GTAGCACTCATG (SEQ ID NO: 885) | AGAGGAGTCGAC (SEQ ID NO: 886) | CGCGTATCTCAG (SEQ ID NO: 887) | ATAGCACCAGAT (SEQ ID NO: 888) |
| GCAACACCATCC (SEQ ID NO: 889) | AACACTCGATCG (SEQ ID NO: 890) | CACCTGTAGTAG (SEQ ID NO: 891) | TAAGTCGGCCTA (SEQ ID NO: 892) | CGAAAGCATTCC (SEQ ID NO: 893) | ATCTCGCTGGGT (SEQ ID NO: 894) |
| GCGATATATCGC (SEQ ID NO: 895) | TGACCGGCTGTT (SEQ ID NO: 896) | CACGAGCTACTC (SEQ ID NO: 897) | CAGGGTAGGGTA (SEQ ID NO: 898) | CCGGACAAGAAG (SEQ ID NO: 899) | GCGCGTGTATCT (SEQ ID NO: 900) |
| CGAGCAATCCTA (SEQ ID NO: 901) | GGAGGAGCAATA (SEQ ID NO: 902) | TCTCGATAAGCG (SEQ ID NO: 903) | CATGGGTGTTAC (SEQ ID NO: 904) | CGATCCGATCTG (SEQ ID NO: 905) | AACGCGAAATTC (SEQ ID NO: 906) |
| AGTCGTGCACAT (SEQ ID NO: 907) | AGCGACGAAGAC (SEQ ID NO: 908) | TAGACACCGTGT (SEQ ID NO: 909) | GATGCCTAATGA (SEQ ID NO: 910) | TGCATCGCGTCA (SEQ ID NO: 911) | ATCTGGACGATC (SEQ ID NO: 912) |
| GTATCTGCGCGT (SEQ ID NO: 913) | CTTCCCTAACTC (SEQ ID NO: 914) | AGACAAGCTTCC (SEQ ID NO: 915) | TTATCGGGCATG (SEQ ID NO: 916) | ATGGACCTAGCT (SEQ ID NO: 917) | CCAGCTGGACTT (SEQ ID NO: 918) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| CGAGGGAAAGTC (SEQ ID NO: 919) | TGGAAGAACGGC (SEQ ID NO: 920) | TCCGCAACCTGA (SEQ ID NO: 921) | TGGACATAAACC (SEQ ID NO: 922) | AGGAATACTCAC (SEQ ID NO: 923) | CTCTAACCTCTA (SEQ ID NO: 924) |
| CAAATTCGGGAT (SEQ ID NO: 925) | GCTAGACACTAC (SEQ ID NO: 926) | TCACTTGGTGCG (SEQ ID NO: 927) | TGACCTCAAGAC (SEQ ID NO: 928) | CTACCTTGAGGA (SEQ ID NO: 929) | CAACCGAGATTA (SEQ ID NO: 930) |
| AGATTGACCAAC (SEQ ID NO: 931) | TTGGATTGAACG (SEQ ID NO: 932) | TTATGTACGGCG (SEQ ID NO: 933) | GCCAAATCGCTC (SEQ ID NO: 934) | CGTGTTATGTGG (SEQ ID NO: 935) | GATTCGAGTGTC (SEQ ID NO: 936) |
| AGTTACGAGCTA (SEQ ID NO: 937) | GATATACCAGTG (SEQ ID NO: 938) | TTGGACGTCCAC (SEQ ID NO: 939) | TCAAAGCTCAAG (SEQ ID NO: 940) | GTACGCACAGTT (SEQ ID NO: 941) | GGTAACCTCTGA (SEQ ID NO: 942) |
| GCATATGCACTG (SEQ ID NO: 943) | AACAAACTGCCA (SEQ ID NO: 944) | TCCAGGGCTATA (SEQ ID NO: 945) | TACCAATCGGTG (SEQ ID NO: 946) | TGGACTCAGCTA (SEQ ID NO: 947) | AGCGAACCTGTT (SEQ ID NO: 948) |
| CAACTCCCGTGA (SEQ ID NO: 949) | GTAGACATGTGT (SEQ ID NO: 950) | GCGTAGAGAGAC (SEQ ID NO: 951) | GTACTCGAACCA (SEQ ID NO: 952) | ACGCGCTAAATC (SEQ ID NO: 953) | ACATGCACATGC (SEQ ID NO: 954) |
| TTGCGTTAGCAG (SEQ ID NO: 955) | TACAGTTACGCG (SEQ ID NO: 956) | GAAACTCCTAGA (SEQ ID NO: 957) | TTCCGGCGATTG (SEQ ID NO: 958) | GACCTGAATACA (SEQ ID NO: 959) | CCTTACCTCCTC (SEQ ID NO: 960) |
| TACGAGCCCTAA (SEQ ID NO: 961) | CAAGCCCTAGTA (SEQ ID NO: 962) | ATCGGGCTTAAC (SEQ ID NO: 963) | GACATGCGGAGA (SEQ ID NO: 964) | ACGTTTGTGGCA (SEQ ID NO: 965) | ACACTGGTCCTG (SEQ ID NO: 966) |
| CACTACGCTAGA (SEQ ID NO: 967) | TAGTGTCGGATC (SEQ ID NO: 968) | TACGCCCATCAG (SEQ ID NO: 969) | CGCACCCATACA (SEQ ID NO: 970) | GCTTAACGTGCC (SEQ ID NO: 971) | AGCTTGAATCAG (SEQ ID NO: 972) |
| TGCAGTCCTCGA (SEQ ID NO: 973) | CTGAGCTCTGCA (SEQ ID NO: 974) | AAGATCGTACTG (SEQ ID NO: 975) | ACATTGAAGCGT (SEQ ID NO: 976) | GAATGGATGGGC (SEQ ID NO: 977) | TAAAGCGAGGAG (SEQ ID NO: 978) |
| ACCATAGCTCCG (SEQ ID NO: 979) | CTTCGACTTTCC (SEQ ID NO: 980) | ACTCATCTTCCA (SEQ ID NO: 981) | GACGACATTTAG (SEQ ID NO: 982) | CATGAACAGTGT (SEQ ID NO: 983) | CGACAACTTGTG (SEQ ID NO: 984) |
| TCGACATCTCTT (SEQ ID NO: 985) | GTCATAAGAACC (SEQ ID NO: 986) | GAGATACAGTTC (SEQ ID NO: 987) | CCAACTACTCGG (SEQ ID NO: 988) | GACTAGTCAGCT (SEQ ID NO: 989) | CGCTGGCTTTAG (SEQ ID NO: 990) |
| GAACACTTTGGA (SEQ ID NO: 991) | GTCCGCAAGTTA (SEQ ID NO: 992) | GCATGCATCCCA (SEQ ID NO: 993) | CCGTTATCAGCG (SEQ ID NO: 994) | CAAGAAATTCGC (SEQ ID NO: 995) | GTGATACCCGCT (SEQ ID NO: 996) |
| GAGCCATCTGTA (SEQ ID NO: 997) | CGTAGAGCTCTC (SEQ ID NO: 998) | GATCTAATCGAG (SEQ ID NO: 999) | TATGGCCAAACC (SEQ ID NO: 1000) | AAGCTCTCCCAG (SEQ ID NO: 1001) | CCAGTTCCAAAG (SEQ ID NO: 1002) |
| TTGGGTACACGT (SEQ ID NO: 1003) | CCTCTGAGAGCT (SEQ ID NO: 1004) | AATCTTGCGCCG (SEQ ID NO: 1005) | TGCCTAAGATCG (SEQ ID NO: 1006) | TGGATCTGTCCG (SEQ ID NO: 1007) | GTCTGGATTGAA (SEQ ID NO: 1008) |
| AAGGCGCTCCTT (SEQ ID NO: 1009) | CCTCGATGCAGT (SEQ ID NO: 1010) | GGAAATCCCATC (SEQ ID NO: 1011) | TTAACTGGAAGC (SEQ ID NO: 1012) | CCTACTCGGTGA (SEQ ID NO: 1013) | GCGCAATAGTAT (SEQ ID NO: 1014) |
| TAATACGGATCG (SEQ ID NO: 1015) | GCGGACTATTCA (SEQ ID NO: 1016) | GACCGTCAATAC (SEQ ID NO: 1017) | ATTCGAGCTGTG (SEQ ID NO: 1018) | ATACCGTCTTTC (SEQ ID NO: 1019) | AGCGTTGTCCAA (SEQ ID NO: 1020) |
| TCGGAATTAGAC (SEQ ID NO: 1021) | CGTGCACAATTG (SEQ ID NO: 1022) | TTGGAACGGCTT (SEQ ID NO: 1023) | GGTCTGTTGAGT (SEQ ID NO: 1024) | AAGGACCGTTTC (SEQ ID NO: 1025) | CGCCTAAACCGT (SEQ ID NO: 1026) |
| TGTGAATTCGGA (SEQ ID NO: 1027) | CGGCCTAAGTTC (SEQ ID NO: 1028) | TCCTAGGTCCGA (SEQ ID NO: 1029) | CTCGTCGACTGA (SEQ ID NO: 1030) | AAGTAGGAAGGA (SEQ ID NO: 1031) | AACACCATCGAC (SEQ ID NO: 1032) |
| CATTCGTGGCGT (SEQ ID NO: 1033) | AGCGCTCACATC (SEQ ID NO: 1034) | TCCTCACTATCA (SEQ ID NO: 1035) | TCTTTCATACCG (SEQ ID NO: 1036) | CGTGCCGCTTAA (SEQ ID NO: 1037) | CTATAGACACGA (SEQ ID NO: 1038) |
| TACTACGTGGCC (SEQ ID NO: 1039) | TGGTTATGGCAC (SEQ ID NO: 1040) | GCCTGCAGTACT (SEQ ID NO: 1041) | CATTCCCGAAAG (SEQ ID NO: 1042) | GCGTCATGCATC (SEQ ID NO: 1043) | CAAGAGCGGATG (SEQ ID NO: 1044) |
| GGCCAGTTCCTA (SEQ ID NO: 1045) | CGAGGTTCTGAT (SEQ ID NO: 1046) | GCCCAAGTTCAC (SEQ ID NO: 1047) | TTGTCAGCTGGA (SEQ ID NO: 1048) | CGTTGGACAAAT (SEQ ID NO: 1049) | CCTTTGGCTGAG (SEQ ID NO: 1050) |
| GATGTTCGCTAG (SEQ ID NO: 1051) | AACTCCTGTGGA (SEQ ID NO: 1052) | ATAAAGAGGAGG (SEQ ID NO: 1053) | ATCTGCGCACCA (SEQ ID NO: 1054) | TTGTTGATGGAG (SEQ ID NO: 1055) | CGACCCATACGT (SEQ ID NO: 1056) |
| CTATCTCCTGTC (SEQ ID NO: 1057) | TAATGGTCGTAG (SEQ ID NO: 1058) | GCGCCGAATCTT (SEQ ID NO: 1059) | CCACGTACGTAA (SEQ ID NO: 1060) | CTTACACTGCTT (SEQ ID NO: 1061) | CTGGATTACGGT (SEQ ID NO: 1062) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| ACTCACAGGAAT (SEQ ID NO: 1063) | TTGCACCGTCGA (SEQ ID NO: 1064) | ATCCCAGCATGC (SEQ ID NO: 1065) | ACGATATGGTCA (SEQ ID NO: 1066) | AATGCGCGTATA (SEQ ID NO: 1067) | ACCACACGTAGT (SEQ ID NO: 1068) |
| ATGATGAGCCTC (SEQ ID NO: 1069) | TGCTACAGACGT (SEQ ID NO: 1070) | GCTTCCAGACAA (SEQ ID NO: 1071) | GAGACAGTGGAA (SEQ ID NO: 1072) | TGCCATTAGAGC (SEQ ID NO: 1073) | CTAGTGACCTAG (SEQ ID NO: 1074) |
| GTCGACAGAGGA (SEQ ID NO: 1075) | ATGGCCTGACTA (SEQ ID NO: 1076) | ACACAGTCCTGA (SEQ ID NO: 1077) | TCGTAGTAATGG (SEQ ID NO: 1078) | CGAAGGGTTGGA (SEQ ID NO: 1079) | GGATTCGTGTCC (SEQ ID NO: 1080) |
| TGTCGCAAATAG (SEQ ID NO: 1081) | ACGCACATACAA (SEQ ID NO: 1082) | ATTATACGGCGC (SEQ ID NO: 1083) | AGGCTGTACTCC (SEQ ID NO: 1084) | GAGCAACATCCT (SEQ ID NO: 1085) | GTGAGATACCTA (SEQ ID NO: 1086) |
| CATCCCTCTACT (SEQ ID NO: 1087) | TGAGTGGTCTGT (SEQ ID NO: 1088) | ATTCAGATGGCA (SEQ ID NO: 1089) | CGGAAGAGAACA (SEQ ID NO: 1090) | TCGTGTTGTGGC (SEQ ID NO: 1091) | CGCGGTTACTAA (SEQ ID NO: 1092) |
| TATACCGCTGCG (SEQ ID NO: 1093) | GATAGCACTCGT (SEQ ID NO: 1094) | TAAACGCGACTC (SEQ ID NO: 1095) | CTGCGGATATAC (SEQ ID NO: 1096) | ATTTCGACCCGG (SEQ ID NO: 1097) | AGGCCCGTTTAC (SEQ ID NO: 1098) |
| AGTTGAGGCATT (SEQ ID NO: 1099) | TAGCGCGAACTT (SEQ ID NO: 1100) | CCTCGGGTACTA (SEQ ID NO: 1101) | CTAGCGTGCGTT (SEQ ID NO: 1102) | TGGATTGTGAAC (SEQ ID NO: 1103) | TGTTGTTGGGAA (SEQ ID NO: 1104) |
| ACAATAGACACC (SEQ ID NO: 1105) | CATACACGCACC (SEQ ID NO: 1106) | TTCACCTGTATC (SEQ ID NO: 1107) | ACCATGTAGAAC (SEQ ID NO: 1108) | CCGTTGGACTAC (SEQ ID NO: 1109) | CTGAATCTGGTG (SEQ ID NO: 1110) |
| CGGTCAATTGAC (SEQ ID NO: 1111) | ACCTCAGTCAAG (SEQ ID NO: 1112) | CTCCAGGTCATG (SEQ ID NO: 1113) | TAGCTCACAGCA (SEQ ID NO: 1114) | TCTGGCTACGAC (SEQ ID NO: 1115) | GGCCTCACTGAT (SEQ ID NO: 1116) |
| GTGGAGTCTCAT (SEQ ID NO: 1117) | TCGACCAAACAC (SEQ ID NO: 1118) | CAGGATTCGTAC (SEQ ID NO: 1119) | GTCTTGGGTCGT (SEQ ID NO: 1120) | TCAGGCGTAAAT (SEQ ID NO: 1121) | GTGGTTCGATGT (SEQ ID NO: 1122) |
| GCTCGAAGATTC (SEQ ID NO: 1123) | CCACCCAGTAAC (SEQ ID NO: 1124) | CGCATACGACCT (SEQ ID NO: 1125) | CTGTATGGAGCT (SEQ ID NO: 1126) | TCACGGTGACAT (SEQ ID NO: 1127) | TCGAGAGTTTGC (SEQ ID NO: 1128) |
| AGGCTTACGTGT (SEQ ID NO: 1129) | ATATCGCGATGA (SEQ ID NO: 1130) | GCCTCGTACTGA (SEQ ID NO: 1131) | ATGCAACTCGAA (SEQ ID NO: 1132) | CAAGGTCACCTC (SEQ ID NO: 1133) | TACGACTCTGGC (SEQ ID NO: 1134) |
| TCTCTACCACTC (SEQ ID NO: 1135) | CGCCGGTAATCT (SEQ ID NO: 1136) | ACCAACAGATTG (SEQ ID NO: 1137) | CTAACTGACGCA (SEQ ID NO: 1138) | CTATACGCGAAC (SEQ ID NO: 1139) | GCGTAACTCTCG (SEQ ID NO: 1140) |
| ACTTCCAACTTC (SEQ ID NO: 1141) | CCGATGCCTTGA (SEQ ID NO: 1142) | GTGGCCTACTAC (SEQ ID NO: 1143) | AACGTCCTGTGC (SEQ ID NO: 1144) | GAGGAGTAAAGC (SEQ ID NO: 1145) | CTTTCCCTTCGA (SEQ ID NO: 1146) |
| CTCACCTAGGAA (SEQ ID NO: 1147) | AGCAGGCACGAA (SEQ ID NO: 1148) | TTCCCTTCTCCG (SEQ ID NO: 1149) | AGACGACGTGGA (SEQ ID NO: 1150) | GCAGCATGTTAA (SEQ ID NO: 1151) | AAGATTTGCAGC (SEQ ID NO: 1152) |
| GTGTTGTCGTGC (SEQ ID NO: 1153) | TACGCAGCACTA (SEQ ID NO: 1154) | CATTTGACGACG (SEQ ID NO: 1155) | AAGGTTCCGATA (SEQ ID NO: 1156) | GTTGGGATCCTC (SEQ ID NO: 1157) | AACGGCTGGAAG (SEQ ID NO: 1158) |
| CCACAGATCGAT (SEQ ID NO: 1159) | CGCTTAGTGCTG (SEQ ID NO: 1160) | AAGTGAAGCGAG (SEQ ID NO: 1161) | AGTTTCTGGTGG (SEQ ID NO: 1162) | TTCAGCGATGGT (SEQ ID NO: 1163) | ATCGTCCGCGAT (SEQ ID NO: 1164) |
| TATCGACACAAG (SEQ ID NO: 1165) | CAAAGTTTGCGA (SEQ ID NO: 1166) | TGCCGCCGTAAT (SEQ ID NO: 1167) | TTCCTCCTGCTA (SEQ ID NO: 1168) | ACAATCCCGAGT (SEQ ID NO: 1169) | TCACAGACAATG (SEQ ID NO: 1170) |
| GATTCCGGCTCA (SEQ ID NO: 1171) | TCGAGCCGATCT (SEQ ID NO: 1172) | AACCTCGGATAA (SEQ ID NO: 1173) | CATCTCAGTCGG (SEQ ID NO: 1174) | GTTCTTGGAGAC (SEQ ID NO: 1175) | GAGACTATATGC (SEQ ID NO: 1176) |
| CGTAATTGCCGC (SEQ ID NO: 1177) | CTCATCATGTTC (SEQ ID NO: 1178) | GTGCTTGTGTAG (SEQ ID NO: 1179) | ATATGCGAGACT (SEQ ID NO: 1180) | TAGCCCTGATGC (SEQ ID NO: 1181) | AGAGGGTGATCG (SEQ ID NO: 1182) |
| GGTGACTAGTTC (SEQ ID NO: 1183) | CCAGGGACTTCT (SEQ ID NO: 1184) | CAACTAGACTCG (SEQ ID NO: 1185) | GACCACTGCTGT (SEQ ID NO: 1186) | TTGTCCCAAGCG (SEQ ID NO: 1187) | TAGAGAATGCTC (SEQ ID NO: 1188) |
| ATGGGTTCCGTC (SEQ ID NO: 1189) | GCAATCCTTGCG (SEQ ID NO: 1190) | AGTGCCCTTGGT (SEQ ID NO: 1191) | ATAGACACTCCG (SEQ ID NO: 1192) | TTCGTACTTCGT (SEQ ID NO: 1193) | AGAGCATCCACT (SEQ ID NO: 1194) |
| TAGGCATGCTTG (SEQ ID NO: 1195) | CCTGCTTCCTTC (SEQ ID NO: 1196) | GGAACGACGTGA (SEQ ID NO: 1197) | GAATCGCCGATT (SEQ ID NO: 1198) | CTGCTCAGGCAT (SEQ ID NO: 1199) | ACAGTCTGCATG (SEQ ID NO: 1200) |
| AACTAGTTCAGG (SEQ ID NO: 1201) | CAAGGCACAAGG (SEQ ID NO: 1202) | TGTCAGCTGTCG (SEQ ID NO: 1203) | TAGAAGGCTCCT (SEQ ID NO: 1204) | GACATCTGACAC (SEQ ID NO: 1205) | AATCGGTCCGAT (SEQ ID NO: 1206) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| ATTCTGCCGAAG (SEQ ID NO: 1207) | GGCCTATAAGTC (SEQ ID NO: 1208) | CTGGTGCTGAAT (SEQ ID NO: 1209) | CGACTAACTAGA (SEQ ID NO: 1210) | CACAACCACAAC (SEQ ID NO: 1211) | CCGTTCAATGGA (SEQ ID NO: 1212) |
| AGCATGTCCCGT (SEQ ID NO: 1213) | TCCATTTCATGC (SEQ ID NO: 1214) | GACAGAGGTGCA (SEQ ID NO: 1215) | TACAACCGAGTA (SEQ ID NO: 1216) | GCACCAATCTGC (SEQ ID NO: 1217) | CTCTCGGCGTAA (SEQ ID NO: 1218) |
| GTACGATATGAC (SEQ ID NO: 1219) | TCGGCGATCATC (SEQ ID NO: 1220) | TCAGACCAACTG (SEQ ID NO: 1221) | CTCATGGTAGCA (SEQ ID NO: 1222) | ATTAGCAGCGTA (SEQ ID NO: 1223) | TCCCTCTGAGAG (SEQ ID NO: 1224) |
| GTGGTGGTTTCC (SEQ ID NO: 1225) | GTTTCACGCGAA (SEQ ID NO: 1226) | AGTGATGTGACT (SEQ ID NO: 1227) | AACGACACGCTT (SEQ ID NO: 1228) | TCCGATAATCGG (SEQ ID NO: 1229) | AAGTTAGTCCGC (SEQ ID NO: 1230) |
| TAGTATGCGCAA (SEQ ID NO: 1231) | ACAAGAACCTTG (SEQ ID NO: 1232) | CTTAGCTACTCT (SEQ ID NO: 1233) | CCTGGCTGAATA (SEQ ID NO: 1234) | CTTTCAGGACCG (SEQ ID NO: 1235) | TCAGATACCAGC (SEQ ID NO: 1236) |
| TGCGCTGAATGT (SEQ ID NO: 1237) | TACTCTCTTAGC (SEQ ID NO: 1238) | TCGGTCCATAGC (SEQ ID NO: 1239) | TTCGGATGTGAA (SEQ ID NO: 1240) | CGTCCTACAGTG (SEQ ID NO: 1241) | TCGAAGACGTAT (SEQ ID NO: 1242) |
| ATGGCTGTCAGT (SEQ ID NO: 1243) | AACTGTTCGCGC (SEQ ID NO: 1244) | CACGTTTATTCC (SEQ ID NO: 1245) | CTAGGTCCGACT (SEQ ID NO: 1246) | GTAACTCAACAG (SEQ ID NO: 1247) | CACTTCTTTGTG (SEQ ID NO: 1248) |
| GTTCTCTTCTCG (SEQ ID NO: 1249) | CGAAGCATCTAC (SEQ ID NO: 1250) | GAAACGGAAACG (SEQ ID NO: 1251) | AGATCCCGTACC (SEQ ID NO: 1252) | CGTGGAAGACGA (SEQ ID NO: 1253) | CGTCGATTGCAC (SEQ ID NO: 1254) |
| CGTAAGATGCCT (SEQ ID NO: 1255) | GTTTGGCCACAC (SEQ ID NO: 1256) | GGTCGTGTCTTG (SEQ ID NO: 1257) | TCTGGTGCATCG (SEQ ID NO: 1258) | GAGAGGGATCAC (SEQ ID NO: 1259) | GTTGCCTCTGAG (SEQ ID NO: 1260) |
| GCGTTCTAGCTG (SEQ ID NO: 1261) | TCAGGTTGCCCA (SEQ ID NO: 1262) | CGTCGTCTAAGA (SEQ ID NO: 1263) | CAGCTGGTTCAA (SEQ ID NO: 1264) | TCGGCTTGGAAT (SEQ ID NO: 1265) | CACCTCCAAGGT (SEQ ID NO: 1266) |
| GTTGTTCTGGGA (SEQ ID NO: 1267) | TCATTCCACTCA (SEQ ID NO: 1268) | CAAGCGTTGTCC (SEQ ID NO: 1269) | GCTGGATTGTCA (SEQ ID NO: 1270) | TGAACAGGTTCA (SEQ ID NO: 1271) | GTAAGCCTCGAT (SEQ ID NO: 1272) |
| GGACTTCCAGCT (SEQ ID NO: 1273) | GTCACATCACGA (SEQ ID NO: 1274) | GACTTATGCCCG (SEQ ID NO: 1275) | TCTTGTTTCTGG (SEQ ID NO: 1276) | GAGAGATCGACG (SEQ ID NO: 1277) | CTCCGCTATAGG (SEQ ID NO: 1278) |
| CTCACAACCGTG (SEQ ID NO: 1279) | CGACATTTCTCT (SEQ ID NO: 1280) | GTGACGTTAGTC (SEQ ID NO: 1281) | TTGAACAAGCCA (SEQ ID NO: 1282) | ATACAAACGCAC (SEQ ID NO: 1283) | ACTGCTATCGCG (SEQ ID NO: 1284) |
| CTGCTATTCCTC (SEQ ID NO: 1285) | GGACGTTAACTA (SEQ ID NO: 1286) | GAGTCTTGGTAA (SEQ ID NO: 1287) | CCAGGTTAATGC (SEQ ID NO: 1288) | GATTCACTGTGG (SEQ ID NO: 1289) | ACCACTTGCCAG (SEQ ID NO: 1290) |
| ATGTCACCGCTG (SEQ ID NO: 1291) | TAGCAGTTGCGT (SEQ ID NO: 1292) | TCGTCGCCAAAC (SEQ ID NO: 1293) | ATTCGTACCTCT (SEQ ID NO: 1294) | GCTTGCCAATCG (SEQ ID NO: 1295) | ACCAGAAATGTC (SEQ ID NO: 1296) |
| TGTAACGCCGAT (SEQ ID NO: 1297) | CACGCTATTGGA (SEQ ID NO: 1298) | AACATGCATGCC (SEQ ID NO: 1299) | TAGCGTTCCAGA (SEQ ID NO: 1300) | CTGACACGAATA (SEQ ID NO: 1301) | ATGCTTGCTCTT (SEQ ID NO: 1302) |
| AGCAGAACATCT (SEQ ID NO: 1303) | AACTTCACTTCC (SEQ ID NO: 1304) | GTCTGTTGAGTG (SEQ ID NO: 1305) | CCAGAAGTGTTC (SEQ ID NO: 1306) | GTTCTAAGGTGA (SEQ ID NO: 1307) | ACAGTTGTACGC (SEQ ID NO: 1308) |
| TGGAGTAGGTGG (SEQ ID NO: 1309) | CCAGTGGATATA (SEQ ID NO: 1310) | TGAGTTCGGTCC (SEQ ID NO: 1311) | ACGATCATCTGG (SEQ ID NO: 1312) | CGTGAATCAACC (SEQ ID NO: 1313) | AGCTACTGCGTC (SEQ ID NO: 1314) |
| TTGGCTCTATTC (SEQ ID NO: 1315) | TGTGTGTAACGC (SEQ ID NO: 1316) | TTACGTGGCGAT (SEQ ID NO: 1317) | ACTGTACATGAG (SEQ ID NO: 1318) | GAGCTAAGTTAC (SEQ ID NO: 1319) | ACTGCCCGATAC (SEQ ID NO: 1320) |
| GATCCCACGTAC (SEQ ID NO: 1321) | CCAATCGTGCAA (SEQ ID NO: 1322) | CAATGCCTCACG (SEQ ID NO: 1323) | TGCCCGGACTTA (SEQ ID NO: 1324) | AGCGATTCCTCG (SEQ ID NO: 1325) | CACAGCGTCCTA (SEQ ID NO: 1326) |
| TACCGCTTCTTC (SEQ ID NO: 1327) | AGGCTAGCAGAG (SEQ ID NO: 1328) | TGTACGGATAAC (SEQ ID NO: 1329) | ATCCCGTACGTG (SEQ ID NO: 1330) | CCAACCCAGATC (SEQ ID NO: 1331) | ACGTCCACTGTG (SEQ ID NO: 1332) |
| TGTGCGATAACA (SEQ ID NO: 1333) | GTCACTCCGAAC (SEQ ID NO: 1334) | AATCAACTAGGC (SEQ ID NO: 1335) | CTTGTTGTTCTG (SEQ ID NO: 1336) | GATTGCTACCAG (SEQ ID NO: 1337) | CGCTAATCGTGA (SEQ ID NO: 1338) |
| GATTATCGACGA (SEQ ID NO: 1339) | CACCGAAATCTG (SEQ ID NO: 1340) | GTGAGGGCAAGT (SEQ ID NO: 1341) | TGACAGAATCCA (SEQ ID NO: 1342) | GGCTCTAACGTA (SEQ ID NO: 1343) | GGCCGTTCGATT (SEQ ID NO: 1344) |
| GCCTAGCCCAAT (SEQ ID NO: 1345) | TGACGTAGAACT (SEQ ID NO: 1346) | CGTGGGCTCATT (SEQ ID NO: 1347) | CACTGTATGAAG (SEQ ID NO: 1348) | AATCTGCACCGA (SEQ ID NO: 1349) | GGAACTTACTCG (SEQ ID NO: 1350) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| GATGTATGTGGT (SEQ ID NO: 1351) | CTATGCCGGCTA (SEQ ID NO: 1352) | CGTACCAGATCC (SEQ ID NO: 1353) | TGGATGCGCATT (SEQ ID NO: 1354) | CCAGCCTTCAGA (SEQ ID NO: 1355) | CAGTTACCCAAG (SEQ ID NO: 1356) |
| ACTCCTTGTGTT (SEQ ID NO: 1357) | GTGGTATGGGAG (SEQ ID NO: 1358) | ATGTTTAGACGG (SEQ ID NO: 1359) | GCCCATATCAGA (SEQ ID NO: 1360) | CCGTGTTAGACA (SEQ ID NO: 1361) | GAGGGACGCAAT (SEQ ID NO: 1362) |
| GTCACGGACATT (SEQ ID NO: 1363) | TGTACCAACCGA (SEQ ID NO: 1364) | ACATGTCACGTG (SEQ ID NO: 1365) | CGTGTGTGCTCA (SEQ ID NO: 1366) | ACCTCTATTCGT (SEQ ID NO: 1367) | TAGGCCATGTAA (SEQ ID NO: 1368) |
| GCGAGCGAAGTA (SEQ ID NO: 1369) | AGGGTACAGGGT (SEQ ID NO: 1370) | CTTTAGCGCTGG (SEQ ID NO: 1371) | ATCCATGAGCGT (SEQ ID NO: 1372) | GGCAAGGCACAA (SEQ ID NO: 1373) | AACCGTCGCCTA (SEQ ID NO: 1374) |
| ATCTACCGAAGC (SEQ ID NO: 1375) | AGAGTGCTAATC (SEQ ID NO: 1376) | CTGGTCTTACGG (SEQ ID NO: 1377) | TAGACTTCAGAG (SEQ ID NO: 1378) | GCCATTATAGAG (SEQ ID NO: 1379) | TTACGAAGTTGG (SEQ ID NO: 1380) |
| ACTTGGTGTAAG (SEQ ID NO: 1381) | TTGGCGGGTTAT (SEQ ID NO: 1382) | CAAGTCGAATAC (SEQ ID NO: 1383) | TGATTCCCGGTG (SEQ ID NO: 1384) | TAACCGAACCAC (SEQ ID NO: 1385) | AGATAGCTCGCT (SEQ ID NO: 1386) |
| TCTTGGAGGTCA (SEQ ID NO: 1387) | CACGATGGTCAT (SEQ ID NO: 1388) | GCAAGTGTGAGG (SEQ ID NO: 1389) | AGTTCCACGGCT (SEQ ID NO: 1390) | GGTGCGTCACTT (SEQ ID NO: 1391) | CTGGTTGGCATC (SEQ ID NO: 1392) |
| TCACCTCCTTGT (SEQ ID NO: 1393) | GTCACCAATCCG (SEQ ID NO: 1394) | CTCGGTCAACCA (SEQ ID NO: 1395) | GGAAGCTTAACT (SEQ ID NO: 1396) | TGTGCTTGTAGG (SEQ ID NO: 1397) | CTGCTTCTTACA (SEQ ID NO: 1398) |
| GCACACCTGATA (SEQ ID NO: 1399) | CACTAACAAACG (SEQ ID NO: 1400) | ACCCTATTGCGG (SEQ ID NO: 1401) | GGAGACGTTCTT (SEQ ID NO: 1402) | TGACTCTGCGGT (SEQ ID NO: 1403) | GTTCGAGTGAAT (SEQ ID NO: 1404) |
| GCGACAATTACA (SEQ ID NO: 1405) | TTCCAGGCAGAT (SEQ ID NO: 1406) | TCCGTTCGTTTA (SEQ ID NO: 1407) | ATTGCGCTACCG (SEQ ID NO: 1408) | GTACACTGATAG (SEQ ID NO: 1409) | TTCTTCTACCGC (SEQ ID NO: 1410) |
| TCATGCTCCATT (SEQ ID NO: 1411) | TATGGTACCCAG (SEQ ID NO: 1412) | ACCACCGTAACC (SEQ ID NO: 1413) | CCGACCAGCTTA (SEQ ID NO: 1414) | TTACATCCCTTG (SEQ ID NO: 1415) | TCTCTCGATCAT (SEQ ID NO: 1416) |
| AGCTGTCAAGCT (SEQ ID NO: 1417) | CACGACTTGACA (SEQ ID NO: 1418) | CATTTCGCACTT (SEQ ID NO: 1419) | CAATCCACCGAA (SEQ ID NO: 1420) | GGTGTGAGAAAG (SEQ ID NO: 1421) | AATCCATGACAG (SEQ ID NO: 1422) |
| GAGAGCAACAGA (SEQ ID NO: 1423) | CTTGGAGGCTTA (SEQ ID NO: 1424) | TTAAGCGCCTGA (SEQ ID NO: 1425) | TACGCGTACAGT (SEQ ID NO: 1426) | CTCTTTGTCGAT (SEQ ID NO: 1427) | GGTATTCAAAGC (SEQ ID NO: 1428) |
| TACTCGGGAACT (SEQ ID NO: 1429) | ACGTGGTTCCAC (SEQ ID NO: 1430) | TGCGGGATTCAT (SEQ ID NO: 1431) | CCGTCAAGATGT (SEQ ID NO: 1432) | GTGAACTGGATT (SEQ ID NO: 1433) | GGTCCACCTAAC (SEQ ID NO: 1434) |
| CGTGCTTAGGCT (SEQ ID NO: 1435) | GACGCTTTGCTG (SEQ ID NO: 1436) | CAAACTGCGTTG (SEQ ID NO: 1437) | TACACGCTGATG (SEQ ID NO: 1438) | CCTAACGGTCCA (SEQ ID NO: 1439) | TGATCACTCTTC (SEQ ID NO: 1440) |
| TACCGAAGGTAT (SEQ ID NO: 1441) | ACAGGGTTTGTA (SEQ ID NO: 1442) | TTAGACTCGGAA (SEQ ID NO: 1443) | CGTTTCAAGGAC (SEQ ID NO: 1444) | TGTAGCCGCTTG (SEQ ID NO: 1445) | GGCACGAAAGGT (SEQ ID NO: 1446) |
| CACTCATCATTC (SEQ ID NO: 1447) | GCCTATGAGATC (SEQ ID NO: 1448) | GACCGATAGGGA (SEQ ID NO: 1449) | GCAGAACTTAGT (SEQ ID NO: 1450) | TACCCGACTAAG (SEQ ID NO: 1451) | CATGAGACTGTA (SEQ ID NO: 1452) |
| GTATTTCGGACG (SEQ ID NO: 1453) | CAAACCTATGGC (SEQ ID NO: 1454) | GGCGAACTGAAG (SEQ ID NO: 1455) | ACCCGTTGATGA (SEQ ID NO: 1456) | CGTAGTACCACA (SEQ ID NO: 1457) | GGTCATCACGAT (SEQ ID NO: 1458) |
| TATCTATCCTGC (SEQ ID NO: 1459) | ATCGCTTAAGGC (SEQ ID NO: 1460) | CGGCACTATCAC (SEQ ID NO: 1461) | GACGTAGAACGG (SEQ ID NO: 1462) | CGGAGAGACATG (SEQ ID NO: 1463) | AGTCTAGAGTAC (SEQ ID NO: 1464) |
| TTGCCAAGAGTC (SEQ ID NO: 1465) | ACCATCCAACGA (SEQ ID NO: 1466) | AGGTGGTGGAGT (SEQ ID NO: 1467) | CGGTACCTACCA (SEQ ID NO: 1468) | CCAAAGCCAGTT (SEQ ID NO: 1469) | TGCGCAAAGGAG (SEQ ID NO: 1470) |
| AGTAGCGGAAGA (SEQ ID NO: 1471) | GCAATAGGAGGA (SEQ ID NO: 1472) | ATTCCCAGAACG (SEQ ID NO: 1473) | GCGTTTGCTAGC (SEQ ID NO: 1474) | TACGATGAGTTG (SEQ ID NO: 1475) | GGTTTGCACATG (SEQ ID NO: 1476) |
| GCAATTAGGTAC (SEQ ID NO: 1477) | CCGAACGTCACT (SEQ ID NO: 1478) | AGACGTTGCTAC (SEQ ID NO: 1479) | AGAAACAGCTCT (SEQ ID NO: 1480) | GCTTGGTAGGTT (SEQ ID NO: 1481) | TGGGTTAACACA (SEQ ID NO: 1482) |
| CATACCGTGAGT (SEQ ID NO: 1483) | ACACCAACACCA (SEQ ID NO: 1484) | AGAATAGCGCTT (SEQ ID NO: 1485) | CTCAGACTCAGA (SEQ ID NO: 1486) | CCGGAATCCATA (SEQ ID NO: 1487) | TAGGTTGCTTGG (SEQ ID NO: 1488) |
| ATGTGTGTAGAC (SEQ ID NO: 1489) | CCATCACATAGG (SEQ ID NO: 1490) | AAGCGTACATTG (SEQ ID NO: 1491) | CCGAGTACAATC (SEQ ID NO: 1492) | ATCGGCTTCCGA (SEQ ID NO: 1493) | CAGGAACCAGGA (SEQ ID NO: 1494) |

TABLE 1-continued

| (SEQ ID NOS 775-2938, respectively, in order of appearance from left to right in each row) | | | | | |
|---|---|---|---|---|---|
| Barcode Sequence Fragments | Barcode Sequence Fragments | Barcode Sequence Fragments | Barcode Sequence Fragments | Barcode Sequence Fragments | Barcode Sequence Fragments |
| CCTGCGAAGTAT (SEQ ID NO: 1495) | CGACACGGAGAA (SEQ ID NO: 1496) | GTTATGACGGAT (SEQ ID NO: 1497) | GATATGAACTGC (SEQ ID NO: 1498) | CACTAGACCCAC (SEQ ID NO: 1499) | TGCTCGATGTGC (SEQ ID NO: 1500) |
| TTCTCTCGACAT (SEQ ID NO: 1501) | GAACCTATGACA (SEQ ID NO: 1502) | AGCCTCATGATG (SEQ ID NO: 1503) | GCAGTCTAAGAT (SEQ ID NO: 1504) | GGAAAGGAGAAT (SEQ ID NO: 1505) | AGGTTTGGCTTG (SEQ ID NO: 1506) |
| GCTCTCCGTAGA (SEQ ID NO: 1507) | ATGCCGGTAATA (SEQ ID NO: 1058) | GTGTATCGCCAC (SEQ ID NO: 1509) | CGGCGCATTATA (SEQ ID NO: 1510) | GAGTATCTGAGT (SEQ ID NO: 1511) | TACTCCAGGCTG (SEQ ID NO: 1512) |
| GTTAAGCTGACC (SEQ ID NO: 1513) | GAACAGCTCTAC (SEQ ID NO: 1514) | CCAAACTCGTCG (SEQ ID NO: 1515) | GGTGCTAATCAC (SEQ ID NO: 1516) | CTCGCTAGATAG (SEQ ID NO: 1517) | TTCGGCATAGTG (SEQ ID NO: 1518) |
| ATGCCATGCCGT (SEQ ID NO: 1519) | GTGAGTCATACC (SEQ ID NO: 1520) | ACGTGAGGAACG (SEQ ID NO: 1521) | CGTTTGGAATGA (SEQ ID NO: 1522) | CCAGGACAGGAA (SEQ ID NO: 1523) | GTGCCATAATCG (SEQ ID NO: 1524) |
| GACATTGTCACG (SEQ ID NO: 1525) | TGGCCGTTACTG (SEQ ID NO: 1526) | TGAATCGAAGCT (SEQ ID NO: 1527) | GGTTAGAGCGGA (SEQ ID NO: 1528) | AAGGGTTAGTCT (SEQ ID NO: 1529) | TGCAGATCCAAC (SEQ ID NO: 1530) |
| GCCAACAACCAT (SEQ ID NO: 1531) | TAGAGCTGCCAT (SEQ ID NO: 1532) | CTGCAGTAAGTA (SEQ ID NO: 1533) | GTAGTAGACCAT (SEQ ID NO: 1534) | GTGACTAGTGAT (SEQ ID NO: 1535) | TCACTCTTGTAC (SEQ ID NO: 1536) |
| ATCAGTACTAGG (SEQ ID NO: 1537) | ATCTAGTGGCAA (SEQ ID NO: 1538) | TATAGGCTCCGC (SEQ ID NO: 1539) | ATCAAGATACGC (SEQ ID NO: 1540) | GGCCTTCAGTCA (SEQ ID NO: 1541) | TGGTGGAGTTTC (SEQ ID NO: 1542) |
| TCCTCGAGCGAT (SEQ ID NO: 1543) | CCTTCAATGGGA (SEQ ID NO: 1544) | ATCGTGTGTTGG (SEQ ID NO: 1545) | TCTATCTGGCTT (SEQ ID NO: 1546) | ACACGTTTGGGT (SEQ ID NO: 1547) | AGAACACGGAAG (SEQ ID NO: 1548) |
| ACCCAAGCGTTA (SEQ ID NO: 1549) | TTGACGACATCG (SEQ ID NO: 1550) | CTTCCGCAGACA (SEQ ID NO: 1551) | GGAAACAAACGG (SEQ ID NO: 1552) | CGAACGTCTATG (SEQ ID NO: 1553) | TCGAAACATGCA (SEQ ID NO: 1554) |
| TGCAGCAAGATT (SEQ ID NO: 1555) | ACATACTGAGCA (SEQ ID NO: 1556) | GCACTATACGCA (SEQ ID NO: 1557) | GATTGGCATAGT (SEQ ID NO: 1558) | TCATGTGAACGA (SEQ ID NO: 1559) | AACTAAGGACTC (SEQ ID NO: 1560) |
| AGCAACATTGCA (SEQ ID NO: 1561) | GGCTAAACTATG (SEQ ID NO: 1562) | TCTGGGCATTGA (SEQ ID NO: 1563) | GAGTTGTACGAT (SEQ ID NO: 1564) | TCTCCGTTCCCT (SEQ ID NO: 1565) | AACTCAATAGCG (SEQ ID NO: 1566) |
| GATGTGGTGTTA (SEQ ID NO: 1567) | AAGAGCAGAGCC (SEQ ID NO: 1568) | CCAATGATAAGC (SEQ ID NO: 1569) | CTCGAAATGCAA (SEQ ID NO: 1570) | CTGATTACGAGA (SEQ ID NO: 1571) | CTTAGAACGTGC (SEQ ID NO: 1572) |
| CAGAAATGTGTC (SEQ ID NO: 1573) | GGAGAGATCACG (SEQ ID NO: 1574) | TTAAACCGCGCC (SEQ ID NO: 1575) | AGAAGAAAGGCA (SEQ ID NO: 1576) | TCTGAATGGTAG (SEQ ID NO: 1577) | CCGTATATGCGC (SEQ ID NO: 1578) |
| GTAGAGGTAGAG (SEQ ID NO: 1579) | TCAACCCGTGAA (SEQ ID NO: 1580) | CTTGCATACCGG (SEQ ID NO: 1581) | CCACTCTCTCTA (SEQ ID NO: 1582) | CATCGTTGGTCG (SEQ ID NO: 1583) | TATGACGTACGA (SEQ ID NO: 1584) |
| CGTGATCCGCTA (SEQ ID NO: 1585) | GTTTGAAACACG (SEQ ID NO: 1586) | GTGCACGATAAT (SEQ ID NO: 1587) | CCTCCTAATTCA (SEQ ID NO: 1588) | TAGATCCTCGGA (SEQ ID NO: 1589) | TCTCTGAACAGG (SEQ ID NO: 1590) |
| GGTTATTTGGCG (SEQ ID NO: 1591) | AGAGAGACAGGT (SEQ ID NO: 1592) | GGTCTAGGTCTA (SEQ ID NO: 1593) | TTCATGGCCAGC (SEQ ID NO: 1594) | TCGGACAGTGTT (SEQ ID NO: 1595) | CCTTTATAGTCC (SEQ ID NO: 1596) |
| GGATCGTAATAC (SEQ ID NO: 1597) | TCGCCAGTGCAT (SEQ ID NO: 1598) | TCAGGACGTATC (SEQ ID NO: 1599) | ATTGGACACGCT (SEQ ID NO: 1600) | TGATGTGCTAAG (SEQ ID NO: 1601) | TGTAGGTGTGCT (SEQ ID NO: 1602) |
| GCATAGCATCAA (SEQ ID NO: 1603) | GCTCAGGACTCT (SEQ ID NO: 1604) | GAAAGGTGAGAA (SEQ ID NO: 1605) | AATTCACCTCCT (SEQ ID NO: 1606) | CAGTAAATCGCA (SEQ ID NO: 1607) | TCCCACGAAACA (SEQ ID NO: 1608) |
| GTGTTAGATGTG (SEQ ID NO: 1609) | CACTTTGGGTGC (SEQ ID NO: 1610) | GAATATACCTGG (SEQ ID NO: 1611) | ATGAAGCACTGT (SEQ ID NO: 1612) | CAAGTTTCCGCG (SEQ ID NO: 1613) | TACGCTACGACC (SEQ ID NO: 1614) |
| TTAGAGCCATGC (SEQ ID NO: 1615) | TCTAGCCTGGCA (SEQ ID NO: 1616) | GTCGCTTGCACA (SEQ ID NO: 1617) | TTGATGTGAGGT (SEQ ID NO: 1618) | ACATCGTTGACG (SEQ ID NO: 1619) | GTCAGTATGGCT (SEQ ID NO: 1620) |
| TGAACCCTATGG (SEQ ID NO: 1621) | AATGCAATGCGT (SEQ ID NO: 1622) | TCTACCACGAAG (SEQ ID NO: 1623) | TCTTGCGGAGTC (SEQ ID NO: 1624) | ACGAAAGAGCAG (SEQ ID NO: 1625) | CCATATCCCGGA (SEQ ID NO: 1626) |
| AGAGTCTTGCCA (SEQ ID NO: 1627) | CGAATGAGTCAT (SEQ ID NO: 1628) | AATATCGGGATC (SEQ ID NO: 1629) | TTAGTCGTGACG (SEQ ID NO: 1630) | TGATGAACCCGT (SEQ ID NO: 1631) | TCGTACCAGGAT (SEQ ID NO: 1632) |
| ACAACACTCCGA (SEQ ID NO: 1633) | CAACGCTAGAAT (SEQ ID NO: 1634) | TAGTGCATTCGG (SEQ ID NO: 1635) | TGCCAGACCACT (SEQ ID NO: 1636) | GCTCTTATGCTT (SEQ ID NO: 1637) | AGTGACTGTCAA (SEQ ID NO: 1638) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| CGATGCTGTTGA (SEQ ID NO: 1639) | ATCAGAGCCCAT (SEQ ID NO: 1640) | TCAATGACCGCA (SEQ ID NO: 1641) | AGGCTCCATGTA (SEQ ID NO: 1642) | CGACCTCGCATA (SEQ ID NO: 1643) | GGTGAGCAAGCA (SEQ ID NO: 1644) |
| ACGACTGCATAA (SEQ ID NO: 1645) | TCTGTAGAGCCA (SEQ ID NO: 1646) | CTATCGGAAGAT (SEQ ID NO: 1647) | ACTACTGAGGAT (SEQ ID NO: 1648) | CTAATTCTCTGC (SEQ ID NO: 1649) | AGTTCATACGGC (SEQ ID NO: 1650) |
| ACGCGAACTAAT (SEQ ID NO: 1651) | CCGACTCTAGGT (SEQ ID NO: 1652) | CGGATTGCTGTA (SEQ ID NO: 1653) | TATCTGGAAGTG (SEQ ID NO: 1654) | GGAAGTGGCCAA (SEQ ID NO: 1655) | TCGCTTTAACCT (SEQ ID NO: 1656) |
| AGCTATGTATGG (SEQ ID NO: 1657) | ATCCTACGAGCA (SEQ ID NO: 1658) | GGTACTGTACCA (SEQ ID NO: 1659) | CAGCTATGGACT (SEQ ID NO: 1660) | GATAATGTGCAC (SEQ ID NO: 1661) | GGCTTACTTGGA (SEQ ID NO: 1662) |
| ACGGGTCATCAT (SEQ ID NO: 1663) | GACAACGAATCT (SEQ ID NO: 1664) | ATCGAATCGAGT (SEQ ID NO: 1665) | TTGCTGGACGCT (SEQ ID NO: 1666) | CTCTGAGGTAAC (SEQ ID NO: 1667) | CCATCCGCAACA (SEQ ID NO: 1668) |
| GAAACATCCCAC (SEQ ID NO: 1669) | TGCGGTTGACTC (SEQ ID NO: 1670) | CTAGCAGTATGA (SEQ ID NO: 1671) | CTACTAGCGGTA (SEQ ID NO: 1672) | ATTTGCTTTGCC (SEQ ID NO: 1673) | CGCAATGAGGGA (SEQ ID NO: 1674) |
| CGTACTCTCGAG (SEQ ID NO: 1675) | TGAGAAGAAAGG (SEQ ID NO: 1676) | GTTAATGGCAGT (SEQ ID NO: 1677) | TACAGGACGGGA (SEQ ID NO: 1678) | TACTGGTAAGAC (SEQ ID NO: 1679) | GCTACAAGCCCT (SEQ ID NO: 1680) |
| TCAGTTCTCGTT (SEQ ID NO: 1681) | TCGGATCTGTGA (SEQ ID NO: 1682) | GTATGGAGCTAT (SEQ ID NO: 1683) | CTCAGGAGACTT (SEQ ID NO: 1684) | TTGAGAAGCACT (SEQ ID NO: 1685) | ATTGAAGTCTGG (SEQ ID NO: 1686) |
| TCGTGCGTGTTG (SEQ ID NO: 1687) | GCCGGTACTCTA (SEQ ID NO: 1688) | CCTTCTGTATAC (SEQ ID NO: 1689) | TCGTTGGGACTA (SEQ ID NO: 1690) | ATAACGGTGTAC (SEQ ID NO: 1691) | GGATTACGCTGT (SEQ ID NO: 1692) |
| GTTATCGCATGG (SEQ ID NO: 1693) | CACAGGATTACC (SEQ ID NO: 1694) | ACGCTGTCGGTT (SEQ ID NO: 1695) | GTCCATGGTTCG (SEQ ID NO: 1696) | TCCCGTAGCATG (SEQ ID NO: 1697) | CAGCAGTCTTCG (SEQ ID NO: 1698) |
| GATCACGAGAGG (SEQ ID NO: 1699) | CGATATCAGTAG (SEQ ID NO: 1700) | CTCGTTTCAGTT (SEQ ID NO: 1701) | TGGCATGTTGGT (SEQ ID NO: 1702) | CAGATGTCGCTA (SEQ ID NO: 1703) | CGTAGCCAACAT (SEQ ID NO: 1704) |
| GTAAATTCAGGC (SEQ ID NO: 1705) | CATAAGGGAGGC (SEQ ID NO: 1706) | GCGAACCTATAC (SEQ ID NO: 1707) | AATCGTAAGGTC (SEQ ID NO: 1708) | TGAGCAACATAC (SEQ ID NO: 1709) | ATACAGCATACG (SEQ ID NO: 1710) |
| AGTGTTTCGGAC (SEQ ID NO: 1711) | TGTGTTACTCCT (SEQ ID NO: 1712) | CTCTCATATGCT (SEQ ID NO: 1713) | CTTACGAGTAGA (SEQ ID NO: 1714) | GGTTCATGAACA (SEQ ID NO: 1715) | CTGAGTGAGTAT (SEQ ID NO: 1716) |
| ACACGCGGTTTA (SEQ ID NO: 1717) | GGTACCTGCAAT (SEQ ID NO: 1718) | CCAGTATCGCGT (SEQ ID NO: 1719) | CAACTGTCAGAC (SEQ ID NO: 1720) | GAGCGAGTTAGG (SEQ ID NO: 1721) | GCTTGTACCGAC (SEQ ID NO: 1722) |
| TGGCAAATCTAG (SEQ ID NO: 1723) | TCGCCTATAAGG (SEQ ID NO: 1724) | TCGTTTCTTCAG (SEQ ID NO: 1725) | TGACTGCGTTAG (SEQ ID NO: 1726) | GCTCAATCAGAA (SEQ ID NO: 1727) | CGCTAGGATGTT (SEQ ID NO: 1728) |
| CACCTTACCTTA (SEQ ID NO: 1729) | AGTGGCACTATC (SEQ ID NO: 1730) | AGTACCTAAGTG (SEQ ID NO: 1731) | GGCTGATGTCAT (SEQ ID NO: 1732) | GACCATGTAGTA (SEQ ID NO: 1733) | GGACAAGTGCGA (SEQ ID NO: 1734) |
| TTAACCTTCCTG (SEQ ID NO: 1735) | TAACCCGATAGA (SEQ ID NO: 1736) | GGATGCAGGATG (SEQ ID NO: 1737) | TGTCCAGTTCGG (SEQ ID NO: 1738) | CACACGCCTGAT (SEQ ID NO: 1739) | GTTCGTATACGG (SEQ ID NO: 1740) |
| TGCCGTATGCCA (SEQ ID NO: 1741) | GTGTGCTAACGT (SEQ ID NO: 1742) | CCACTTGAGAGT (SEQ ID NO: 1743) | ACTCGTGATAGC (SEQ ID NO: 1744) | TCTTCGCAGCAG (SEQ ID NO: 1745) | CGGGTAGGGTAA (SEQ ID NO: 1746) |
| CGTGACAATAGT (SEQ ID NO: 1747) | CTTGCGGCAATC (SEQ ID NO: 1748) | GCACTTCATTTC (SEQ ID NO: 1749) | GCCCTCAAATGC (SEQ ID NO: 1750) | TCTCATGTGGAG (SEQ ID NO: 1751) | ATGCGCCCGTAT (SEQ ID NO: 1752) |
| CGCTACAACTCG (SEQ ID NO: 1753) | TGAGGTTTGATG (SEQ ID NO: 1754) | AGAATCCACCAC (SEQ ID NO: 1755) | TAAATCACGCGC (SEQ ID NO: 1756) | TTCCATCATGTC (SEQ ID NO: 1757) | CTGTCGTGTCAG (SEQ ID NO: 1758) |
| TTAAGACAGTCG (SEQ ID NO: 1759) | ATTGCTGGTCGA (SEQ ID NO: 1760) | CTCAAGTCAAAG (SEQ ID NO: 1761) | GGCGTGCATTAT (SEQ ID NO: 1762) | GTCCTACACAGC (SEQ ID NO: 1763) | ACGGTGAAAGCG (SEQ ID NO: 1764) |
| TCTGCACTGAGC (SEQ ID NO: 1765) | AAGAAGCCGGAC (SEQ ID NO: 1766) | GTACCTAGCCTG (SEQ ID NO: 1767) | GGTCAATATTGG (SEQ ID NO: 1768) | GAGGTGGGAGTT (SEQ ID NO: 1769) | TCACGTATTCTC (SEQ ID NO: 1770) |
| CGCAGATTAGTA (SEQ ID NO: 1771) | ACGGGATACAGG (SEQ ID NO: 1772) | CACTGAGTACGT (SEQ ID NO: 1773) | AGGTTCTTAGGC (SEQ ID NO: 1774) | TGGCCTAGTCAA (SEQ ID NO: 1775) | GAAGGTGAAGGT (SEQ ID NO: 1776) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TGGGTCCCACAT (SEQ ID NO: 1777) | AAGAGTCTCTAG (SEQ ID NO: 1778) | TCAAGCAATACG (SEQ ID NO: 1779) | TAGGTGCAATCA (SEQ ID NO: 1780) | TCCTTCCCTGCT (SEQ ID NO: 1781) | CACATGGGTTTG (SEQ ID NO: 1782) |
| CACTGGTGCATA (SEQ ID NO: 1783) | TCCGTCATGGGT (SEQ ID NO: 1784) | CATGTTGGAACA (SEQ ID NO: 1785) | GTCCAAAGCGTT (SEQ ID NO: 1786) | CTCACTGCTTCT (SEQ ID NO: 1787) | TAGGTAACCGAT (SEQ ID NO: 1788) |
| AACGTAGGCTCT (SEQ ID NO: 1789) | AGATCTATGCAG (SEQ ID NO: 1790) | ATGGGACCTTCA (SEQ ID NO: 1791) | AGATCGTGCCTA (SEQ ID NO: 1792) | TAGGAGAGACAG (SEQ ID NO: 1793) | GGTCGAATTGCT (SEQ ID NO: 1794) |
| AGTTGTAGTCCG (SEQ ID NO: 1795) | GCACAAGGCAAG (SEQ ID NO: 1796) | GCTATTCCTCAT (SEQ ID NO: 1797) | CTCCTCCCTTAC (SEQ ID NO: 1798) | TGTTCCTCTCAC (SEQ ID NO: 1799) | TGTAAACAGGTC (SEQ ID NO: 1800) |
| TCGTCAAACCCG (SEQ ID NO: 1801) | CGGCAAACACTT (SEQ ID NO: 1802) | GTCTCTGAAAGA (SEQ ID NO: 1803) | GAGCATTACATG (SEQ ID NO: 1804) | GCGTTAACCCAA (SEQ ID NO: 1805) | GTTACGTGGTTG (SEQ ID NO: 1806) |
| TAATCGGTGCCA (SEQ ID NO: 1807) | GCGAGTTCCTGT (SEQ ID NO: 1808) | GTTCTGCTTGTT (SEQ ID NO: 1809) | AAGCACGTCTCA (SEQ ID NO: 1810) | CCACACGTTTGG (SEQ ID NO: 1811) | AGGATCAGGGAA (SEQ ID NO: 1812) |
| TTGATCCGGTAG (SEQ ID NO: 1813) | TTCCGAATCGGC (SEQ ID NO: 1814) | GTCAAGACCTCA (SEQ ID NO: 1815) | TAGGGAGACCGA (SEQ ID NO: 1816) | ACAGCATAGCTC (SEQ ID NO: 1817) | TAGGACGGGAGT (SEQ ID NO: 1818) |
| CGGGTGTTTGCT (SEQ ID NO: 1819) | TACCTAGTGAGA (SEQ ID NO: 1820) | TTGTTACGTTCC (SEQ ID NO: 1821) | ATAAGCCCAATG (SEQ ID NO: 1822) | AATGTGGCTCAC (SEQ ID NO: 1823) | GCAACGAACGAG (SEQ ID NO: 1824) |
| TTGACCGCGGTT (SEQ ID NO: 1825) | CGTTCTGGTGGT (SEQ ID NO: 1826) | CAGTTCGAGATA (SEQ ID NO: 1827) | ACGTGCCTTAGA (SEQ ID NO: 1828) | GAGTTCCATTGG (SEQ ID NO: 1829) | TGACGGTTTAGC (SEQ ID NO: 1830) |
| GTGCAACCAATC (SEQ ID NO: 1831) | TTGGTCTCCTCT (SEQ ID NO: 1832) | AATGTCACCAGA (SEQ ID NO: 1833) | TCCTGCTATCTA (SEQ ID NO: 1834) | TCTGATCGAGGT (SEQ ID NO: 1835) | AAGTGTGGTTGT (SEQ ID NO: 1836) |
| GCTTGAGCTTGA (SEQ ID NO: 1837) | CTGCATACTGAG (SEQ ID NO: 1838) | CAGCCTGCAAAT (SEQ ID NO: 1839) | CACGAAAGCAGG (SEQ ID NO: 1840) | CAAGTGAAGGGA (SEQ ID NO: 1841) | CTTCGTTTCGTA (SEQ ID NO: 1842) |
| CGCTGTGGATTA (SEQ ID NO: 1843) | CAGGGCCTTTGT (SEQ ID NO: 1844) | TTGCAAGTACCG (SEQ ID NO: 1845) | TCAAGTCCGCAC (SEQ ID NO: 1846) | TGCCCATCAGGT (SEQ ID NO: 1847) | CACCGCTCACAA (SEQ ID NO: 1848) |
| CTGTCAGTGACC (SEQ ID NO: 1849) | CGATGAATATCG (SEQ ID NO: 1850) | GCTTCTCTCACT (SEQ ID NO: 1851) | TAGCACCTAAAG (SEQ ID NO: 1852) | AGGTTGCTGTAA (SEQ ID NO: 1853) | CTGAACAGTTGC (SEQ ID NO: 1854) |
| ACGATTCGAGTC (SEQ ID NO: 1855) | GTCAATTAGTGG (SEQ ID NO: 1856) | CGAGATAGTTTG (SEQ ID NO: 1857) | GTTTCTTGTTGC (SEQ ID NO: 1858) | TAAGTACTGCAG (SEQ ID NO: 1859) | CGCTCTTAACGG (SEQ ID NO: 1860) |
| GGTTCGGTCCAT (SEQ ID NO: 1861) | AGTACGCAGTCT (SEQ ID NO: 1862) | CGCGTCAAACTA (SEQ ID NO: 1863) | ACCTAAAGCTGC (SEQ ID NO: 1864) | GCCGATTGTAAC (SEQ ID NO: 1865) | GGAGTCTCTTGC (SEQ ID NO: 1866) |
| CTGATCCATCTT (SEQ ID NO: 1867) | AGCAGCTATTGC (SEQ ID NO: 1868) | TTGACACACGAC (SEQ ID NO: 1869) | ACCACGATGCTA (SEQ ID NO: 1870) | CGGTGGAAGCAA (SEQ ID NO: 1871) | AAGTTCCGGCCT (SEQ ID NO: 1872) |
| TATGTGCCGGCT (SEQ ID NO: 1873) | CTCGGATAGATC (SEQ ID NO: 1874) | ATAAGGTCGCCT (SEQ ID NO: 1875) | GCATCTAAAGCC (SEQ ID NO: 1876) | GTTGAAGCACCT (SEQ ID NO: 1877) | GCGCTGTTTAAG (SEQ ID NO: 1878) |
| TGGTCGCATCGT (SEQ ID NO: 1879) | TTCCCGAAACGA (SEQ ID NO: 1880) | TTGCCCTTTGAT (SEQ ID NO: 1881) | CGTTGACACCCA (SEQ ID NO: 1882) | TGTCTTTACCTG (SEQ ID NO: 1883) | GACAATTCCGAA (SEQ ID NO: 1884) |
| TGTAAGACTTGG (SEQ ID NO: 1885) | GAACTTTAGCGC (SEQ ID NO: 1886) | CCTGGAATTAAG (SEQ ID NO: 1887) | CTTGGGTTAGGT (SEQ ID NO: 1888) | CCTTGTTCACCT (SEQ ID NO: 1889) | AGGTCTCCCGAT (SEQ ID NO: 1890) |
| CGGATCTAGTGT (SEQ ID NO: 1891) | TCCTTAGAAGGC (SEQ ID NO: 1892) | TGAGACCCTACA (SEQ ID NO: 1893) | CTACGTGAAATG (SEQ ID NO: 1894) | CAACCACTCGGT (SEQ ID NO: 1895) | ACGATGGTTGAT (SEQ ID NO: 1896) |
| CGATCTTCGAGC (SEQ ID NO: 1897) | GATGGACTTCAA (SEQ ID NO: 1898) | AAGTATCCTGCG (SEQ ID NO: 1899) | GCCAGCTTCATG (SEQ ID NO: 1900) | TCTTAGTCGGGC (SEQ ID NO: 1901) | AGACTTCTCAGG (SEQ ID NO: 1902) |
| GTCGAATTTGCG (SEQ ID NO: 1903) | TACTGAGCCTCG (SEQ ID NO: 1904) | CAAATGGTCGTC (SEQ ID NO: 1905) | GTGCATTCGCCA (SEQ ID NO: 1906) | GTACCGTTGCAA (SEQ ID NO: 1907) | GGATGTCTTCGC (SEQ ID NO: 1908) |
| GCATCAGAGTTA (SEQ ID NO: 1909) | AGAAGGCCTTAT (SEQ ID NO: 1910) | ACACATAAGTCG (SEQ ID NO: 1911) | TGAGAGTCCCTC (SEQ ID NO: 1912) | CTGATAGCACAC (SEQ ID NO: 1913) | TCCTGAACACAG (SEQ ID NO: 1914) |
| GTGGTCATCGTA (SEQ ID NO: 1915) | TGGAGCCTTGTC (SEQ ID NO: 1916) | TACTGCCAGTGA (SEQ ID NO: 1917) | CTCTGTAGCCGA (SEQ ID NO: 1918) | ACAGGTAGAGAG (SEQ ID NO: 1919) | AAGCCTCTACGA (SEQ ID NO: 1920) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| CTGAAGGGCGAA (SEQ ID NO: 1921) | CTCGATGTAAGC (SEQ ID NO: 1922) | GAGTTTACGGTC (SEQ ID NO: 1923) | GCAGTAACTGTC (SEQ ID NO: 1924) | TGCTCACGTGTG (SEQ ID NO: 1925) | TACTTGCCACGG (SEQ ID NO: 1926) |
| CGCTCACAGAAT (SEQ ID NO: 1927) | AGCTTCGACAGT (SEQ ID NO: 1928) | GGCACACCCTTA (SEQ ID NO: 1929) | CATATAGCCCGA (SEQ ID NO: 1930) | GTAATAATGCCG (SEQ ID NO: 1931) | GCATAAACGACT (SEQ ID NO: 1932) |
| ATTCGGTAGTGC (SEQ ID NO: 1933) | ATACGCATCAAG (SEQ ID NO: 1934) | GTCCAGCTATGA (SEQ ID NO: 1935) | CAGTGCACGTCT (SEQ ID NO: 1936) | CTCGGCACCAAT (SEQ ID NO: 1937) | CTTTGCACTTTG (SEQ ID NO: 1938) |
| CGAGCTGTTACC (SEQ ID NO: 1939) | AGATGTCCGTCA (SEQ ID NO: 1940) | TCGCGCAACTGT (SEQ ID NO: 1941) | CAAGACTGACCT (SEQ ID NO: 1942) | ACTCGAAACCAA (SEQ ID NO: 1943) | TGACACGACATC (SEQ ID NO: 1944) |
| CAACACATGCTG (SEQ ID NO: 1945) | GCACCTGTTGAA (SEQ ID NO: 1946) | ATTCCTCTCCAC (SEQ ID NO: 1947) | CCGATAAAGGTT (SEQ ID NO: 1948) | ACCGTAAGACAT (SEQ ID NO: 1949) | TGTTGACGATGC (SEQ ID NO: 1950) |
| ATTCTCTCACGT (SEQ ID NO: 1951) | CCTAGAGAAACT (SEQ ID NO: 1952) | TGGTTCATCCTT (SEQ ID NO: 1953) | CTTTGTCAGGGC (SEQ ID NO: 1954) | ATCACGGGAGAG (SEQ ID NO: 1955) | GACAAGAAGGTG (SEQ ID NO: 1956) |
| CGACTCTAAACG (SEQ ID NO: 1957) | GAGGTTCTTGAC (SEQ ID NO: 1958) | AGCACTTTGAGA (SEQ ID NO: 1959) | TCCGAAGACAAT (SEQ ID NO: 1960) | TCACTGCTAGGA (SEQ ID NO: 1961) | GAGTGCTCTAAC (SEQ ID NO: 1962) |
| GTCTTCAGCAAG (SEQ ID NO: 1963) | CTGTAAAGGTTG (SEQ ID NO: 1964) | CCACGGTACTTG (SEQ ID NO: 1965) | ACTTCGGATGCA (SEQ ID NO: 1966) | CTAATCAGAGTG (SEQ ID NO: 1967) | TTGTGTCTCCCT (SEQ ID NO: 1968) |
| CGGATAACCTCC (SEQ ID NO: 1969) | TGAGTCATTGAG (SEQ ID NO: 1970) | ACTAGTTGGACC (SEQ ID NO: 1971) | TAACATCAGGCA (SEQ ID NO: 1972) | TTGGCATTGGCA (SEQ ID NO: 1973) | CGTTACCGGACT (SEQ ID NO: 1974) |
| AGGGTGACTTTA (SEQ ID NO: 1975) | TACGGCAGTTCA (SEQ ID NO: 1976) | GATCAACCCACA (SEQ ID NO: 1977) | TAATGAGATGCC (SEQ ID NO: 1978) | TATAATCCGAGG (SEQ ID NO: 1979) | TGTGCACGCCAT (SEQ ID NO: 1980) |
| GACTTCATGCGA (SEQ ID NO: 1981) | CTCTAGAAGAGT (SEQ ID NO: 1982) | ATGCGAGACTTC (SEQ ID NO: 1983) | ATCGGTGGAATT (SEQ ID NO: 1984) | TCCAGATAGCGT (SEQ ID NO: 1985) | TCCCAGAAGCTC (SEQ ID NO: 1986) |
| GCCTGTCTGCAA (SEQ ID NO: 1987) | TGCACAGTCGCT (SEQ ID NO: 1988) | CGCTTGTGTAGC (SEQ ID NO: 1989) | TATAGTGGGCCT (SEQ ID NO: 1990) | AATCCGGTCACC (SEQ ID NO: 1991) | ACGCTAGATTGA (SEQ ID NO: 1992) |
| ACTGATGGCCTC (SEQ ID NO: 1993) | CATGCGGATCCT (SEQ ID NO: 1994) | ATGAATGCGTCC (SEQ ID NO: 1995) | TCGACGGAGAGA (SEQ ID NO: 1996) | AAGTGCTTGGTA (SEQ ID NO: 1997) | TTACGGCTGGTC (SEQ ID NO: 1998) |
| TTCGATGCCGCA (SEQ ID NO: 1999) | TGCTCCGTAGAA (SEQ ID NO: 2000) | GACTCTGCTCAG (SEQ ID NO: 2001) | ATCTGACATCGG (SEQ ID NO: 2002) | GGTAAAGGGTCG (SEQ ID NO: 2003) | TGCAATGGTACC (SEQ ID NO: 2004) |
| TGTGGCTCGTGT (SEQ ID NO: 2005) | TGATAGGTACAC (SEQ ID NO: 2006) | CACGTACACGTA (SEQ ID NO: 2007) | GATAGGGCCAAG (SEQ ID NO: 2008) | GCTTTCTCAATC (SEQ ID NO: 2009) | AACAGGTCTCTG (SEQ ID NO: 2010) |
| AACTTTCAGGAG (SEQ ID NO: 2011) | CGAGTTCATCGA (SEQ ID NO: 2012) | CAGAGCTAATTG (SEQ ID NO: 2013) | CGGGCTTCATCA (SEQ ID NO: 2014) | ACAGTGCGTCCT (SEQ ID NO: 2015) | GTGCTAATAGGT (SEQ ID NO: 2016) |
| TGCACGTGATAA (SEQ ID NO: 2017) | AAGCAGATTGTC (SEQ ID NO: 2018) | TTATCCAGTCCT (SEQ ID NO: 2019) | CGTAACGTAATG (SEQ ID NO: 2020) | TAGGAACTCACC (SEQ ID NO: 2021) | GCGATCACACCT (SEQ ID NO: 2022) |
| GTTCGGTGTCCA (SEQ ID NO: 2023) | TAGAGGCGTAGG (SEQ ID NO: 2024) | CTAAGACGTCGT (SEQ ID NO: 2025) | TAGCGACCTCAC (SEQ ID NO: 2026) | TGTATTGGACAG (SEQ ID NO: 2027) | AATGGACCGTTC (SEQ ID NO: 2028) |
| AAGACAGCTATC (SEQ ID NO: 2029) | TCAGCGCCGTTA (SEQ ID NO: 2030) | GGCTCAGATTCC (SEQ ID NO: 2031) | ACCCTGGGTATC (SEQ ID NO: 2032) | AGAAAGGGTGTG (SEQ ID NO: 2033) | GTACGTCACTGA (SEQ ID NO: 2034) |
| ATTGACCGGTCA (SEQ ID NO: 2035) | TAGACCGACTCC (SEQ ID NO: 2036) | CTTGGTAGTGCC (SEQ ID NO: 2037) | AGCGAGAAGTGA (SEQ ID NO: 2038) | GCTCACAATGTG (SEQ ID NO: 2039) | TAGCCTGTCGTG (SEQ ID NO: 2040) |
| TTCTCCATCACA (SEQ ID NO: 2041) | GTCAACGCTGTC (SEQ ID NO: 2042) | GTGCTGCGCTTA (SEQ ID NO: 2043) | CTTCAAGATGGA (SEQ ID NO: 2044) | TATTGCAGCAGC (SEQ ID NO: 2045) | ACAGACGACGGA (SEQ ID NO: 2046) |
| CGTAGGTAGAGG (SEQ ID NO: 2047) | ACAGGAGGGTGT (SEQ ID NO: 2048) | AGTAGGAGGCAC (SEQ ID NO: 2049) | GCTGCGTATACC (SEQ ID NO: 2050) | AGATTCGCTCGA (SEQ ID NO: 2051) | TCTATGCGAACG (SEQ ID NO: 2052) |
| ATTTAGGACGAC (SEQ ID NO: 2053) | GCTGTCGTCAAC (SEQ ID NO: 2054) | ACCCGGATTTCG (SEQ ID NO: 2055) | ACAAGGCAAGGC (SEQ ID NO: 2056) | AGCCGGAGAGTA (SEQ ID NO: 2057) | CTATGAGTCCAG (SEQ ID NO: 2058) |
| GGATAGCCAAGG (SEQ ID NO: 2059) | ATAGAGGCCATT (SEQ ID NO: 2060) | CGTCCGTATGAA (SEQ ID NO: 2061) | CGTTAGTGACTG (SEQ ID NO: 2062) | CCTGTAGGTTGC (SEQ ID NO: 2063) | AGTCCTTTATCC (SEQ ID NO: 2064) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TGGTTGGTTACG (SEQ ID NO: 2065) | AAGCTTGAAACC (SEQ ID NO: 2066) | CGATTAGGAATC (SEQ ID NO: 2067) | GCCGTTGATGCT (SEQ ID NO: 2068) | AAGGCCTTTACG (SEQ ID NO: 2069) | AGTTTGCGAGAT (SEQ ID NO: 2070) |
| GTCGTCCAAATG (SEQ ID NO: 2071) | TAAGCGTCTCGA (SEQ ID NO: 2072) | ACGTCTCAGTGC (SEQ ID NO: 2073) | TTCAACCTTTCG (SEQ ID NO: 2074) | CTAGGCAATCAA (SEQ ID NO: 2075) | TCAACGTGCTGC (SEQ ID NO: 2076) |
| CAACGTGCTCCA (SEQ ID NO: 2077) | ATAGCTTCGTGG (SEQ ID NO: 2078) | TAGTAGCACCTG (SEQ ID NO: 2079) | TGGGAGGTGGTA (SEQ ID NO: 2080) | AGGACCTCGTTC (SEQ ID NO: 2081) | GAACCAGTACTC (SEQ ID NO: 2082) |
| TACACAAGTCGC (SEQ ID NO: 2083) | CGGGATCAAATT (SEQ ID NO: 2084) | AGGTCATCTTGG (SEQ ID NO: 2085) | CGCCTGCCAATA (SEQ ID NO: 2086) | CTTGTCTGGAGC (SEQ ID NO: 2087) | TGATAATGCACG (SEQ ID NO: 2088) |
| GCGTCCATGAAT (SEQ ID NO: 2089) | AGTCATCGAATG (SEQ ID NO: 2090) | TGCTGTGACCAC (SEQ ID NO: 2091) | TTGAGCTTGAGC (SEQ ID NO: 2092) | ACCGCATCAATG (SEQ ID NO: 2093) | TAGTGATGACCA (SEQ ID NO: 2094) |
| GTAATGCGTAAC (SEQ ID NO: 2095) | ATCTTGGAGTCG (SEQ ID NO: 2096) | ACACTTCGGCAA (SEQ ID NO: 2097) | TACTAACGCGGT (SEQ ID NO: 2098) | AAGGTCAATCGT (SEQ ID NO: 2099) | ACAGCCACCCAT (SEQ ID NO: 2100) |
| GTCGCCGTACAT (SEQ ID NO: 2101) | AGCACCGGTCTT (SEQ ID NO: 2102) | ACCTCCCGGATA (SEQ ID NO: 2103) | ATCCGCAGTCAC (SEQ ID NO: 2104) | ACCTACTTGTCT (SEQ ID NO: 2105) | TATGTTGACGGC (SEQ ID NO: 2106) |
| GGAATCCGATTA (SEQ ID NO: 2107) | GCAAATCAGCCT (SEQ ID NO: 2108) | GAAGAGGGTTGA (SEQ ID NO: 2109) | AGTGTACCATGA (SEQ ID NO: 2110) | TGTTGGATCGTG (SEQ ID NO: 2111) | CGAGTATACAAC (SEQ ID NO: 2112) |
| CACCCGATGGTT (SEQ ID NO: 2113) | GCAAGCTGTCTC (SEQ ID NO: 2114) | AGTAGACTTACG (SEQ ID NO: 2115) | CCGATTGAATCG (SEQ ID NO: 2116) | ACTGGATCTCGC (SEQ ID NO: 2117) | TACACCTTACCT (SEQ ID NO: 2118) |
| TTCTGAGAGGTA (SEQ ID NO: 2119) | AGCGGCCTATTA (SEQ ID NO: 2120) | TGGAAACCATTG (SEQ ID NO: 2121) | TATATGTGCGAG (SEQ ID NO: 2122) | TCAAGGGACCTT (SEQ ID NO: 2123) | CGTTCAAGCTAG (SEQ ID NO: 2124) |
| ATCCCTACGGAA (SEQ ID NO: 2125) | TCTTCAACTACC (SEQ ID NO: 2126) | AGTCCGAGTTGT (SEQ ID NO: 2127) | CACCCACGTTGA (SEQ ID NO: 2128) | AAGTCGACACAT (SEQ ID NO: 2129) | AACTCGCGCTAC (SEQ ID NO: 2130) |
| GGTTCCATTAGG (SEQ ID NO: 2131) | TGGAATTCGGCT (SEQ ID NO: 2132) | CCGCGATTTCGA (SEQ ID NO: 2133) | TAGTGGGTCAAT (SEQ ID NO: 2134) | AACATTGCAGGT (SEQ ID NO: 2135) | TACCAGGATTGC (SEQ ID NO: 2136) |
| GTGTTCCCAGAA (SEQ ID NO: 2137) | TAAGATGCAGTC (SEQ ID NO: 2138) | ACACACCCTGAC (SEQ ID NO: 2139) | CCTAAACTACGG (SEQ ID NO: 2140) | CCATGAAGTGTA (SEQ ID NO: 2141) | GGTTGTAAGTGT (SEQ ID NO: 2142) |
| CCGAGGTATAAT (SEQ ID NO: 2143) | TGCCGAGTAATC (SEQ ID NO: 2144) | TCACGAGTCACA (SEQ ID NO: 2145) | ACTCCCGTGTGA (SEQ ID NO: 2146) | TCCACAGGGTTC (SEQ ID NO: 2147) | CAACGAACCATC (SEQ ID NO: 2148) |
| AGCGTAATTAGC (SEQ ID NO: 2149) | ACCTTGACAAGA (SEQ ID NO: 2150) | CACAAAGCGATT (SEQ ID NO: 2151) | CTGCAAGCCTGT (SEQ ID NO: 2152) | TCATTAGCGTGG (SEQ ID NO: 2153) | CCATGCTTAGAG (SEQ ID NO: 2154) |
| CTCGTGAATGAC (SEQ ID NO: 2155) | GTAACCACCACC (SEQ ID NO: 2156) | CACCGTGACACT (SEQ ID NO: 2157) | CCAACAGCCAAT (SEQ ID NO: 2158) | ATGTCGAATAGC (SEQ ID NO: 2159) | AATGGCGACTAT (SEQ ID NO: 2160) |
| AGGTGAGTTCTA (SEQ ID NO: 2161) | CATAGCTCGGTC (SEQ ID NO: 2162) | GAAGATCTATCG (SEQ ID NO: 2163) | CGGTTCACATAG (SEQ ID NO: 2164) | CTGACCGTTAAG (SEQ ID NO: 2165) | GACAGGTTGTAT (SEQ ID NO: 2166) |
| CCTGTCCTATCT (SEQ ID NO: 2167) | AACCATGCCAAC (SEQ ID NO: 2168) | GACGGAACAGAC (SEQ ID NO: 2169) | TCAACAGTAGTG (SEQ ID NO: 2170) | TCGGGCTCTTAG (SEQ ID NO: 2171) | GACTATAATGGC (SEQ ID NO: 2172) |
| GGTTTAACACGC (SEQ ID NO: 2173) | TATGGAGCTAGT (SEQ ID NO: 2174) | GGACCGCTTTCA (SEQ ID NO: 2175) | AACACATGGGTT (SEQ ID NO: 2176) | ACTTTAAGGGTG (SEQ ID NO: 2177) | TTCAGGAACTAG (SEQ ID NO: 2178) |
| AGACAGTAGGAG (SEQ ID NO: 2179) | ACTACCTCTTCA (SEQ ID NO: 2180) | CACGGTCCTATG (SEQ ID NO: 2181) | ATCGTAGTGGTC (SEQ ID NO: 2182) | TGGACCACTAGT (SEQ ID NO: 2183) | CAACAGGTAACT (SEQ ID NO: 2184) |
| GCCACGACTTAC (SEQ ID NO: 2185) | GATGATAACCCA (SEQ ID NO: 2186) | GAATGACGTTTG (SEQ ID NO: 2187) | CGAGTCACGATT (SEQ ID NO: 2188) | AACCAGCAGATT (SEQ ID NO: 2189) | TAGTTGAGCTGA (SEQ ID NO: 2190) |
| ATTGTTCCTACC (SEQ ID NO: 2191) | GGCCCAATATAA (SEQ ID NO: 2192) | ACTTACGCCACG (SEQ ID NO: 2193) | AGTGCGTTCTAG (SEQ ID NO: 2194) | ATCGAGGATCTA (SEQ ID NO: 2195) | GTCTCAAAGCAC (SEQ ID NO: 2196) |
| GCCGTAAACTTG (SEQ ID NO: 2197) | TTGTATGACAGG (SEQ ID NO: 2198) | ACGCCTTTCTTA (SEQ ID NO: 2199) | TTCTTAACGCCT (SEQ ID NO: 2200) | TAGCTGGCGTTC (SEQ ID NO: 2201) | AGTTGCCTGAAC (SEQ ID NO: 2202) |
| GCAGATTTCCAG (SEQ ID NO: 2203) | GGTAAGTTTGAC (SEQ ID NO: 2204) | TTGGTGCCTGTG (SEQ ID NO: 2205) | ACCCAGTATGGT (SEQ ID NO: 2206) | CACAAGTATCGA (SEQ ID NO: 2207) | TGGTAGTCTGAA (SEQ ID NO: 2208) |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| AGATGATCAGTC (SEQ ID NO: 2209) | CTACCACGGTAC (SEQ ID NO: 2210) | CATCGGATCTGA (SEQ ID NO: 2211) | CGTTAAGTCAGC (SEQ ID NO: 2212) | GATTGTGCAACC (SEQ ID NO: 2213) | GCATGTCGAAAT (SEQ ID NO: 2214) |
| GAGACGTGTTCT (SEQ ID NO: 2215) | CGGTCTGTCTGA (SEQ ID NO: 2216) | CATGTCTTCCAT (SEQ ID NO: 2217) | TCACAACACCGC (SEQ ID NO: 2218) | CTACAGGGTCTC (SEQ ID NO: 2219) | CCTATGCACGGT (SEQ ID NO: 2220) |
| TATCACCGGCAC (SEQ ID NO: 2221) | GTACATGTCGCC (SEQ ID NO: 2222) | GTTACAGTTGGC (SEQ ID NO: 2223) | AGCAAGGTCTTC (SEQ ID NO: 2224) | GTACCAGGTACT (SEQ ID NO: 2225) | GCGTGGTCATTA (SEQ ID NO: 2226) |
| TATGCCAGAGAT (SEQ ID NO: 2227) | TTCTAGAGTGCG (SEQ ID NO: 2228) | CGGACTCGTTAC (SEQ ID NO: 2229) | TCTAAACCCTCT (SEQ ID NO: 2230) | GTATACCCTTCT (SEQ ID NO: 2231) | AGTCACATCCGC (SEQ ID NO: 2232) |
| AGGTCCAAATCA (SEQ ID NO: 2233) | ACGGATGTTATG (SEQ ID NO: 2234) | TCTCGCACTGGA (SEQ ID NO: 2235) | CCTGATCACACG (SEQ ID NO: 2236) | TAGGTCTAGGTC (SEQ ID NO: 2237) | AGCGTCTGAACT (SEQ ID NO: 2238) |
| ACCGTGCTCACA (SEQ ID NO: 2239) | TTGAGGCTACAA (SEQ ID NO: 2240) | TTCTGGTCTTGT (SEQ ID NO: 2241) | AAGCTGCCTAGT (SEQ ID NO: 2242) | GACAGTAGCTTC (SEQ ID NO: 2243) | ATCGCGACTGCT (SEQ ID NO: 2244) |
| CTCCCTTTGTGT (SEQ ID NO: 2245) | GTAGGAACCGGA (SEQ ID NO: 2246) | GTCCACTTGGAC (SEQ ID NO: 2247) | ATTTGTGGGTAG (SEQ ID NO: 2248) | TGAACGTTGGAT (SEQ ID NO: 2249) | TGGAGGTTCTCA (SEQ ID NO: 2250) |
| AGCTGCACCTAA (SEQ ID NO: 2251) | ACATCTAGCAGA (SEQ ID NO: 2252) | GATTTAGAGGCT (SEQ ID NO: 2253) | TACATGGAGCAT (SEQ ID NO: 2254) | AGTGTGAACGTT (SEQ ID NO: 2255) | TGCTTGTAGGCA (SEQ ID NO: 2256) |
| CCTTGACCGATG (SEQ ID NO: 2257) | CCGACATTGTAG (SEQ ID NO: 2258) | GTCAGCCGTTAA (SEQ ID NO: 2259) | GCCTCAGCAGTT (SEQ ID NO: 2260) | ATGGTCACAAAC (SEQ ID NO: 2261) | CTTAAATGGGCA (SEQ ID NO: 2262) |
| CTATCATCCTCA (SEQ ID NO: 2263) | CATGTAAGGCTC (SEQ ID NO: 2264) | ACGGTTTCTGGA (SEQ ID NO: 2265) | CATCTTCTGATC (SEQ ID NO: 2266) | ACATAGCGGTTC (SEQ ID NO: 2267) | GGTATCACCCTG (SEQ ID NO: 2268) |
| ACTCTAGCCGGT (SEQ ID NO: 2269) | TGCAAGCTAAGT (SEQ ID NO: 2270) | GCAGCCATATTG (SEQ ID NO: 2271) | CAGGTTGTGCCT (SEQ ID NO: 2272) | GCTGTTTGACCG (SEQ ID NO: 2273) | CGCCTTGATAAG (SEQ ID NO: 2274) |
| CGATAGGCCTTA (SEQ ID NO: 2275) | GTGTGTGCCATA (SEQ ID NO: 2276) | ATAGGTGTGCTA (SEQ ID NO: 2277) | GGTTGCCCTGTA (SEQ ID NO: 2278) | CGAATACTGACA (SEQ ID NO: 2279) | CGTTTATCCGTT (SEQ ID NO: 2280) |
| AATGACCTCGTG (SEQ ID NO: 2281) | TGACAACCGAAT (SEQ ID NO: 2282) | ACCTAGCTAGTG (SEQ ID NO: 2283) | TGGTTTCGAAGA (SEQ ID NO: 2284) | TATCCTGGTTTC (SEQ ID NO: 2285) | TTGTACTCACTC (SEQ ID NO: 2286) |
| CTTAGGCATGTG (SEQ ID NO: 2287) | TAGGCTCGTGCT (SEQ ID NO: 2288) | GTCCTGACACTG (SEQ ID NO: 2289) | TGCGTTCTAGCG (SEQ ID NO: 2290) | CATTGTCCCTAT (SEQ ID NO: 2291) | TTCCCACCCATT (SEQ ID NO: 2292) |
| CCAGATATAGCA (SEQ ID NO: 2293) | CTCCTTAAGGCG (SEQ ID NO: 2294) | GGACTCAACTAA (SEQ ID NO: 2295) | AGTCCACTGGTA (SEQ ID NO: 2296) | ACCGACGCTTGT (SEQ ID NO: 2297) | GCCGCATTCGAT (SEQ ID NO: 2298) |
| GAGAGTCCACTT (SEQ ID NO: 2299) | TTGCCTGGGTCA (SEQ ID NO: 2300) | ATACGGGTTCGT (SEQ ID NO: 2301) | GAACTCGCTATG (SEQ ID NO: 2302) | CTGTGATCGGAT (SEQ ID NO: 2303) | |
| GAACGGGACGTA (SEQ ID NO: 2304) | CAATTCTGCTTC (SEQ ID NO: 2305) | CCTTTCACCTGT (SEQ ID NO: 2306) | GGTAGTTCATAG (SEQ ID NO: 2307) | ATGTACACCGGT (SEQ ID NO: 2308) | |
| ACGTGTAGGCTT (SEQ ID NO: 2309) | ACTGGCAAACCT (SEQ ID NO: 2310) | ATCAGCCAGCTC (SEQ ID NO: 2311) | AGGATGGGATGC (SEQ ID NO: 2312) | TAAGCTAAACCG (SEQ ID NO: 2313) | |
| GGTCTCCTACAG (SEQ ID NO: 2314) | AATCAGAGCTTG (SEQ ID NO: 2315) | GCTCCACAACGT (SEQ ID NO: 2316) | CAGTGATACTGC (SEQ ID NO: 2317) | CATTGGGAGTTC (SEQ ID NO: 2318) | |
| ACTGACTTAAGG (SEQ ID NO: 2319) | CAATGTAGACAC (SEQ ID NO: 2320) | AAGGAGTGCGCA (SEQ ID NO: 2321) | GAGGATACTACT (SEQ ID NO: 2322) | GATCGGTTAATG (SEQ ID NO: 2323) | |
| GATGCTGCCGTT (SEQ ID NO: 2324) | TGGCGATACGTT (SEQ ID NO: 2325) | AGGGAAAGGATC (SEQ ID NO: 2326) | GCATCGTCTGGT (SEQ ID NO: 2327) | CAGCGACTGTTA (SEQ ID NO: 2328) | |
| TTCCTAGGCCAG (SEQ ID NO: 2329) | GCCTTACGATAG (SEQ ID NO: 2330) | ACGACGCATTTG (SEQ ID NO: 2331) | TATGGGTAGCTA (SEQ ID NO: 2332) | GAGCCCAAAGAG (SEQ ID NO: 2333) | |
| ATTAAGCCTGGA (SEQ ID NO: 2334) | TACCTGTGTCTT (SEQ ID NO: 2335) | CGTCACTCCAAG (SEQ ID NO: 2336) | AGGTATTACCGA (SEQ ID NO: 2337) | CGATCACCACAA (SEQ ID NO: 2338) | |
| TGGCTTTCTATC (SEQ ID NO: 2339) | AACGAGGCAACG (SEQ ID NO: 2340) | TTACACAAAGGC (SEQ ID NO: 2341) | TGTCAAAGTGAC (SEQ ID NO: 2342) | CTAGAGCTCCCA (SEQ ID NO: 2343) | |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| ACAGCTCAAACA (SEQ ID NO: 2344) | GAAGACAGCGAC (SEQ ID NO: 2345) | GTATAGTCCGTG (SEQ ID NO: 2346) | GTAACGGCTCTA (SEQ ID NO: 2347) | GAACGCAATTCC (SEQ ID NO: 2348) | |
| GAGCGTATCCAT (SEQ ID NO: 2349) | ACACCTGCGATC (SEQ ID NO: 2350) | TCGTAAGCCGTC (SEQ ID NO: 2351) | GTGTACATAACG (SEQ ID NO: 2352) | ATCCGTCTGACG (SEQ ID NO: 2353) | |
| ATGGGCGAATGG (SEQ ID NO: 2354) | GGCGTTGCATTC (SEQ ID NO: 2355) | TGACGCCTCCAA (SEQ ID NO: 2356) | TGCTGCTCAACG (SEQ ID NO: 2357) | TGAAATGTCCCG (SEQ ID NO: 2358) | |
| GATCTCTGGGTA (SEQ ID NO: 2359) | ACTAGCGTTCAG (SEQ ID NO: 2360) | TTCTCGGTTCTC (SEQ ID NO: 2361) | CGGATGCAAGAG (SEQ ID NO: 2362) | ATTCGCCAAGAA (SEQ ID NO: 2363) | |
| CATCATACGGGT (SEQ ID NO: 2364) | TTGCGACAAAGT (SEQ ID NO: 2365) | GCTACTGGTATG (SEQ ID NO: 2366) | TGACATTCACGG (SEQ ID NO: 2367) | TACGTGATCCCG (SEQ ID NO: 2368) | |
| TACGGATTATGG (SEQ ID NO: 2369) | TGCGAGTATATG (SEQ ID NO: 2370) | GAATCCTCACCG (SEQ ID NO: 2371) | CACATATTGGGC (SEQ ID NO: 2372) | TGGGTAGATCTC (SEQ ID NO: 2373) | |
| ATAGCGAACTCA (SEQ ID NO: 2374) | TACCACAACGAA (SEQ ID NO: 2375) | CCTGACACACAC (SEQ ID NO: 2376) | TTCAATAGGGAC (SEQ ID NO: 2377) | AGCAATCGGTAT (SEQ ID NO: 2378) | |
| TAACGCTGTGTG (SEQ ID NO: 2379) | TCTGGAACGGTT (SEQ ID NO: 2380) | CAGCGTTTAGCC (SEQ ID NO: 2381) | ATAGCCGATGTC (SEQ ID NO: 2382) | GTTGGACGAAGG (SEQ ID NO: 2383) | |
| AACCAAACTCGA (SEQ ID NO: 2384) | GTACTACCTCGG (SEQ ID NO: 2385) | GGTATGGCTACT (SEQ ID NO: 2386) | ATGCGTAATGCA (SEQ ID NO: 2387) | ACACTATGAAGC (SEQ ID NO: 2388) | |
| GCCGTCTCGTAA (SEQ ID NO: 2389) | TTCCTGTTAACC (SEQ ID NO: 2390) | ACAATGTCACAG (SEQ ID NO: 2391) | ACTCCGATAGAC (SEQ ID NO: 2392) | ACGGAAATCCCT (SEQ ID NO: 2393) | |
| CTGGGTATCTCG (SEQ ID NO: 2394) | CTATCCAAGTGG (SEQ ID NO: 2395) | GCCATAGTGTGT (SEQ ID NO: 2396) | GCTGAGCCTTTG (SEQ ID NO: 2397) | GGTTTCTATCCT (SEQ ID NO: 2398) | |
| GACTACCCGTTG (SEQ ID NO: 2399) | CAGTCTAGTACG (SEQ ID NO: 2400) | GGTCCCGAAATT (SEQ ID NO: 2401) | AACAGAGAGAGC (SEQ ID NO: 2402) | ACGCAATGTCTG (SEQ ID NO: 2403) | |
| GCGTTGCAAACT (SEQ ID NO: 2404) | GTGTCCGGATTC (SEQ ID NO: 2405) | TCTGCGAGTCTG (SEQ ID NO: 2406) | AATTCCGAACGC (SEQ ID NO: 2407) | TCGGTTACGCTG (SEQ ID NO: 2408) | |
| AACCGCATAAGT (SEQ ID NO: 2409) | TGTGGTGATGTA (SEQ ID NO: 2410) | ATGTAGGCTTAG (SEQ ID NO: 2411) | TTAGTACGCAGA (SEQ ID NO: 2412) | AAGCCATTGAAC (SEQ ID NO: 2413) | |
| ACCTTACACCTT (SEQ ID NO: 2414) | CTTTCGTTCAAC (SEQ ID NO: 2415) | TGCTTCCAATTC (SEQ ID NO: 2416) | GAATCTGACAAC (SEQ ID NO: 2417) | CGATTGTTCCGG (SEQ ID NO: 2418) | |
| GTAGGTGCTTAC (SEQ ID NO: 2419) | CCGAAGATTCTG (SEQ ID NO: 2420) | GCCGAGATAATT (SEQ ID NO: 2421) | CACACTGAAGTC (SEQ ID NO: 2422) | CCTAAGAGCATC (SEQ ID NO: 2423) | |
| CGCATTTGGATG (SEQ ID NO: 2424) | GTTGGCGTTACA (SEQ ID NO: 2425) | TCGAGTATCGAA (SEQ ID NO: 2426) | ACTATCAGTGGC (SEQ ID NO: 2427) | GATGGTTTCAGC (SEQ ID NO: 2428) | |
| ATAACATGTGCG (SEQ ID NO: 2429) | GAAGTAGCGAGC (SEQ ID NO: 2430) | GCCCTATCTTCT (SEQ ID NO: 2431) | AGACTCAGACTC (SEQ ID NO: 2432) | TAATTGCAGAGC (SEQ ID NO: 2433) | |
| CTTGAGAAATCG (SEQ ID NO: 2434) | TTGCGGACCCTA (SEQ ID NO: 2435) | AGGTACGCAATT (SEQ ID NO: 2436) | GACCTTTCAAGG (SEQ ID NO: 2437) | TACCGGCTTGCA (SEQ ID NO: 2438) | |
| CTACACAGCACA (SEQ ID NO: 2439) | GCGGAAACATGG (SEQ ID NO: 2440) | GTCCCTATTATC (SEQ ID NO: 2441) | CAAGCAGGTGAG (SEQ ID NO: 2442) | AGTCGGCATCTC (SEQ ID NO: 2443) | |
| GAAATGCTACGT (SEQ ID NO: 2444) | AACGTTAGTGTG (SEQ ID NO: 2445) | TGGGACATATCC (SEQ ID NO: 2446) | GGAGAACGACAC (SEQ ID NO: 2447) | ATATACCTGCGG (SEQ ID NO: 2448) | |
| TCTGAGGTTGCC (SEQ ID NO: 2449) | TGCATGACAGTC (SEQ ID NO: 2450) | GAACGATCATGT (SEQ ID NO: 2451) | CAGCTTCGACTG (SEQ ID NO: 2452) | TGTCTGACGCAA (SEQ ID NO: 2453) | |
| GATCATTCTCTC (SEQ ID NO: 2454) | TCAATCGCTTTC (SEQ ID NO: 2455) | TTCAGACCAGCC (SEQ ID NO: 2456) | ATCTTTCCCTGA (SEQ ID NO: 2457) | CATATCCAGCCG (SEQ ID NO: 2458) | |
| AGACATACCGTA (SEQ ID NO: 2459) | CTACCGATTGCG (SEQ ID NO: 2460) | ACGCATCGCACT (SEQ ID NO: 2461) | CTCCGAACAACA (SEQ ID NO: 2462) | TCTCACTGTTCC (SEQ ID NO: 2463) | |

TABLE 1-continued

| (SEQ ID NOS 775-2938, respectively, in order of appearance from left to right in each row) | | | | | |
|---|---|---|---|---|---|
| Barcode Sequence Fragments | Barcode Sequence Fragments | Barcode Sequence Fragments | Barcode Sequence Fragments | Barcode Sequence Fragments | Barcode Sequence Fragments |
| GATCCTCATGCG (SEQ ID NO: 2464) | TCACCCAAGGTA (SEQ ID NO: 2465) | CAGTAGCGATAT (SEQ ID NO: 2466) | GGTCACACATCA (SEQ ID NO: 2467) | GCTATGGAACTC (SEQ ID NO: 2468) | |
| ATTATCGTCCCT (SEQ ID NO: 2469) | AGCCAGTCATAC (SEQ ID NO: 2470) | GGATACTCGCAT (SEQ ID NO: 2471) | AGAACTTGACGT (SEQ ID NO: 2472) | CTCCACATTCCT (SEQ ID NO: 2473) | |
| CCAGACCGCTAT (SEQ ID NO: 2474) | TAACGGCGCTCT (SEQ ID NO: 2475) | CTAAGTTGCAAG (SEQ ID NO: 2476) | CTTGAACCCGAC (SEQ ID NO: 2477) | TACGTTTGGCGA (SEQ ID NO: 2478) | |
| AGCTCTAGAAAC (SEQ ID NO: 2479) | GTTTGCTCGAGA (SEQ ID NO: 2480) | CGCGATATCGTC (SEQ ID NO: 2481) | GACGTGTCCATC (SEQ ID NO: 2482) | AATCGCCCTTGG (SEQ ID NO: 2483) | |
| TCCATCGACGTG (SEQ ID NO: 2484) | CAAACGCACTAA (SEQ ID NO: 2485) | CTGATGTACACG (SEQ ID NO: 2486) | AGAGCCAAGAGC (SEQ ID NO: 2487) | CGGCGATGAAAG (SEQ ID NO: 2488) | |
| CGATGTGTGGTT (SEQ ID NO: 2489) | GAACAAAGAGCG (SEQ ID NO: 2490) | AGGCATCTGCTC (SEQ ID NO: 2491) | TGGGAATGTTGT (SEQ ID NO: 2492) | CCGCTACGTGAT (SEQ ID NO: 2493) | |
| GCGAAGTTGGGA (SEQ ID NO: 2494) | GCTAAGTGATGT (SEQ ID NO: 2495) | AGACCTGACCCT (SEQ ID NO: 2496) | CAATCATAGGTG (SEQ ID NO: 2497) | CTGGTAAGTCCA (SEQ ID NO: 2498) | |
| GCATTCGGCGTT (SEQ ID NO: 2499) | AAGGGACAAGTG (SEQ ID NO: 2500) | CATCGACGAGTT (SEQ ID NO: 2501) | ATAAGTAACCGC (SEQ ID NO: 2502) | AGAGCTCCTCTG (SEQ ID NO: 2503) | |
| CGCCATTGTGCA (SEQ ID NO: 2504) | AGTGTCGATTCG (SEQ ID NO: 2505) | GGAGTTGAGGTG (SEQ ID NO: 2506) | GACTTGGTAAAC (SEQ ID NO: 2507) | GACAAACCTTGC (SEQ ID NO: 2508) | |
| TCCAACTGCAGA (SEQ ID NO: 2509) | CTATTAAGCGGC (SEQ ID NO: 2510) | AGCATCCCTAAG (SEQ ID NO: 2511) | AATCACGGTGCT (SEQ ID NO: 2512) | CATTAGCTGGAA (SEQ ID NO: 2513) | |
| TAAAGACCCGTA (SEQ ID NO: 2514) | CCTACCATTGTT (SEQ ID NO: 2515) | CAGACGAGGAAC (SEQ ID NO: 2516) | ACGACCTACGCT (SEQ ID NO: 2517) | CCACAACGATCA (SEQ ID NO: 2518) | |
| TGTATCTTCACC (SEQ ID NO: 2519) | GAGTCCGTTGCT (SEQ ID NO: 2520) | TCGCTACAGATG (SEQ ID NO: 2521) | GATGTCATAGCC (SEQ ID NO: 2522) | CCGGTGTGATTC (SEQ ID NO: 2523) | |
| GACTGACTCGTC (SEQ ID NO: 2524) | GATAACTGTACG (SEQ ID NO: 2525) | TCGGTGTACCAA (SEQ ID NO: 2526) | TGTTGCGTTTCT (SEQ ID NO: 2527) | ATAGTGTTCGGC (SEQ ID NO: 2528) | |
| TCGTGGATAGCT (SEQ ID NO: 2529) | TAAACCTGGACA (SEQ ID NO: 2530) | AACACGGTTTGA (SEQ ID NO: 2531) | GCATACTACAGC (SEQ ID NO: 2532) | TAATCTCGCCGG (SEQ ID NO: 2533) | |
| GACGCACTAACT (SEQ ID NO: 2534) | CCGAATTGACAA (SEQ ID NO: 2535) | CTTGTGCGACAA (SEQ ID NO: 2536) | GAGGTATTCTGA (SEQ ID NO: 2537) | CAGATCCCAACC (SEQ ID NO: 2538) | |
| GGCGATTTACGT (SEQ ID NO: 2539) | CTGGCATCTAGC (SEQ ID NO: 2540) | AGAGTAAGCCGG (SEQ ID NO: 2541) | ATGTTCCTCATC (SEQ ID NO: 2542) | AGAGATTATGCC (SEQ ID NO: 2543) | |
| TAAGGCATCGCT (SEQ ID NO: 2544) | GGTGGTCGTTCT (SEQ ID NO: 2545) | AGACACCAATGT (SEQ ID NO: 2546) | CGGTATAGCAAT (SEQ ID NO: 2547) | TGAATACCTGGC (SEQ ID NO: 2548) | |
| ACCCATACAGCC (SEQ ID NO: 2549) | ACTATGGGCTAA (SEQ ID NO: 2550) | AATACGTCAAGC (SEQ ID NO: 2551) | CTTGGCCTGTAG (SEQ ID NO: 2552) | CTCCCACTAGAG (SEQ ID NO: 2553) | |
| CGCACTACGCAT (SEQ ID NO: 2554) | GCATTGAGTTCG (SEQ ID NO: 2555) | ATGGCAATTCAG (SEQ ID NO: 2556) | ATCAAACGCATG (SEQ ID NO: 2557) | AGCCCTGCTACA (SEQ ID NO: 2558) | |
| CAGTCGTTAAGA (SEQ ID NO: 2559) | GTTGCTGAGTCC (SEQ ID NO: 2560) | CAGTGTCATGAA (SEQ ID NO: 2561) | CGGTCCTGAGTT (SEQ ID NO: 2562) | CCTTATAGAAGG (SEQ ID NO: 2563) | |
| CTACGAAAGCCT (SEQ ID NO: 2564) | CTATGGTGAACC (SEQ ID NO: 2565) | CGGTGACCTACT (SEQ ID NO: 2566) | CTCGAGCGTACT (SEQ ID NO: 2567) | GGCCAAGGAAGT (SEQ ID NO: 2568) | |
| ATAATTGCCGAG (SEQ ID NO: 2569) | GGACCAAGGGAT (SEQ ID NO: 2570) | ACATCCCTACTT (SEQ ID NO: 2571) | TTAAGGACTGAC (SEQ ID NO: 2572) | CCTCTACTCTAA (SEQ ID NO: 2573) | |
| GGCATGTTATCG (SEQ ID NO: 2574) | GTATTGGTCAGA (SEQ ID NO: 2575) | TGAAGCACACTA (SEQ ID NO: 2576) | GTGGAAGAGACA (SEQ ID NO: 2577) | GAGTCGATCTTG (SEQ ID NO: 2578) | |
| AGGCACAGTAGG (SEQ ID NO: 2579) | AGAACCGTCATA (SEQ ID NO: 2580) | GTGAATGTTCGA (SEQ ID NO: 2581) | TAACTAGGACGT (SEQ ID NO: 2582) | GACCTACCGCAT (SEQ ID NO: 2583) | |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| CTACTTACATCC (SEQ ID NO: 2584) | AACTGGAACCCT (SEQ ID NO: 2585) | AGTCGCTACACA (SEQ ID NO: 2586) | GAAAGAGTCTCT (SEQ ID NO: 2587) | ATGTAATAGGCC (SEQ ID NO: 2588) | |
| CTCTTCTGATCA (SEQ ID NO: 2589) | ATACTCGGCTGC (SEQ ID NO: 2590) | AACCACTAACCG (SEQ ID NO: 2591) | TCACCGGAATCC (SEQ ID NO: 2592) | GACTCGCAACTA (SEQ ID NO: 2593) | |
| ATGCTAACCACG (SEQ ID NO: 2594) | ACGCTTAACGAC (SEQ ID NO: 2595) | TTCGCTAACCTT (SEQ ID NO: 2596) | CGACTGCAGCTT (SEQ ID NO: 2597) | CTGACGATCCGT (SEQ ID NO: 2598) | |
| ACCAATCTCGGC (SEQ ID NO: 2599) | AGCTTACCGACC (SEQ ID NO: 2600) | GACACTCACCGT (SEQ ID NO: 2601) | GTTACCCGAGCT (SEQ ID NO: 2602) | GTGCGAGGACAA (SEQ ID NO: 2603) | |
| TATCCAAGCGCA (SEQ ID NO: 2604) | AGGGCTATAGTT (SEQ ID NO: 2605) | TCAGAGTAGACT (SEQ ID NO: 2606) | CCTAGGTCCCAA (SEQ ID NO: 2607) | GCAGAGAGGCTA (SEQ ID NO: 2608) | |
| GTACTGAAGATC (SEQ ID NO: 2609) | TGTCTCGCAAGC (SEQ ID NO: 2610) | GACCAAATGTCC (SEQ ID NO: 2611) | TTGAGTGGTCTG (SEQ ID NO: 2612) | TCCTTGTCCTTG (SEQ ID NO: 2613) | |
| TCGCCGTGTACA (SEQ ID NO: 2614) | CAGCCGCATATC (SEQ ID NO: 2615) | GATGCAACTTCG (SEQ ID NO: 2616) | CGACGAGATTAT (SEQ ID NO: 2617) | CTACAATTGAGG (SEQ ID NO: 2618) | |
| AACTGCGATATG (SEQ ID NO: 2619) | GATACGTTCGCA (SEQ ID NO: 2620) | CACCACAGAATC (SEQ ID NO: 2621) | AGTACTGCCTGC (SEQ ID NO: 2622) | GTTGACCATCGC (SEQ ID NO: 2623) | |
| CTTCCAACTCAT (SEQ ID NO: 2624) | CCAAGATTCGCC (SEQ ID NO: 2625) | GGAGCTCTGTAT (SEQ ID NO: 2626) | GAAGTCCACACT (SEQ ID NO: 2627) | CAATGAGGGAGA (SEQ ID NO: 2628) | |
| GAGATCGCCTAT (SEQ ID NO: 2629) | GAGGCTGATTTA (SEQ ID NO: 2630) | CCTTAAGGGCAT (SEQ ID NO: 2631) | GTAGAATGCTCC (SEQ ID NO: 2632) | AAGCAACGGTGG (SEQ ID NO: 2633) | |
| TGTACATCGCCG (SEQ ID NO: 2634) | GAGTTAGCATCA (SEQ ID NO: 2635) | GCTGCTACAAGT (SEQ ID NO: 2636) | ACACCCTATCGG (SEQ ID NO: 2637) | CTCCAATGACGC (SEQ ID NO: 2638) | |
| TGTTAAGCAGCA (SEQ ID NO: 2639) | TGTAGTATAGGC (SEQ ID NO: 2640) | GTAAACGACTTG (SEQ ID NO: 2641) | AGGAGGATAAAG (SEQ ID NO: 2642) | ATGGAAGGTGGC (SEQ ID NO: 2643) | |
| ACGGCGTTATGT (SEQ ID NO: 2644) | CTCACGCAATGC (SEQ ID NO: 2645) | CGCCCTCTTCTT (SEQ ID NO: 2646) | GCATGGGTTATC (SEQ ID NO: 2647) | CCGGCTTATGTG (SEQ ID NO: 2648) | |
| ACTTTGCTTTGC (SEQ ID NO: 2649) | GTCCCGTGAAAT (SEQ ID NO: 2650) | ACTAGACGACTA (SEQ ID NO: 2651) | GTTCCCAACGGT (SEQ ID NO: 2652) | CTGTGCAACGTC (SEQ ID NO: 2653) | |
| CAAAGCGGTATT (SEQ ID NO: 2654) | GGACAGTGTATT (SEQ ID NO: 2655) | AGGTTAAGTGCT (SEQ ID NO: 2656) | GTCAGAGTATTG (SEQ ID NO: 2657) | AGTCAATGGCCT (SEQ ID NO: 2658) | |
| CGAAACTACGTA (SEQ ID NO: 2659) | ACACGACTATAG (SEQ ID NO: 2660) | ATATCCTGGGAC (SEQ ID NO: 2661) | ATGACAGAACCT (SEQ ID NO: 2662) | GGAACACATGTT (SEQ ID NO: 2663) | |
| GAGGACCAGCAA (SEQ ID NO: 2664) | GTGTAGGTGCTT (SEQ ID NO: 2665) | TTGTAGCCGACA (SEQ ID NO: 2666) | ACAAGTGCTGCT (SEQ ID NO: 2667) | AGCGCATATCCA (SEQ ID NO: 2668) | |
| AATAGCATGTCG (SEQ ID NO: 2669) | TGAACTAGCGTC (SEQ ID NO: 2670) | TCAGAAGCTCAA (SEQ ID NO: 2671) | AATAGTCGTGAC (SEQ ID NO: 2672) | TGCAACTTGCAG (SEQ ID NO: 2673) | |
| CGGAGTAATCCT (SEQ ID NO: 2674) | TCCGAGTCACCA (SEQ ID NO: 2675) | ACTGTGACGTCC (SEQ ID NO: 2676) | TACAAGTGGTCC (SEQ ID NO: 2677) | GTGTGGCAGAAG (SEQ ID NO: 2678) | |
| CTGTGTCCATGG (SEQ ID NO: 2679) | TCCTCTTTGGTC (SEQ ID NO: 2680) | TTGCAGTGCAAC (SEQ ID NO: 2681) | GCTGGTCTAGTC (SEQ ID NO: 2682) | GTGACCCTGTCA (SEQ ID NO: 2683) | |
| CTTCGCGGATGT (SEQ ID NO: 2684) | TCCACCCTCTAT (SEQ ID NO: 2685) | TGTCATGGCTGA (SEQ ID NO: 2686) | GGCATCCTGGTT (SEQ ID NO: 2687) | CACGCAGTCTAC (SEQ ID NO: 2688) | |
| ATAGGCTGTAGT (SEQ ID NO: 2689) | TCGTGACGCTAA (SEQ ID NO: 2690) | TTCGTGAGGATA (SEQ ID NO: 2691) | GTGCCTCAGGTT (SEQ ID NO: 2692) | TTCACTGTGCGG (SEQ ID NO: 2693) | |
| TGTGTAGCCATG (SEQ ID NO: 2694) | ACGGCTAGTTCC (SEQ ID NO: 2695) | TCCCAACCTAGG (SEQ ID NO: 2696) | ATTACAGCGACA (SEQ ID NO: 2697) | AACGAATACCAC (SEQ ID NO: 2698) | |
| AAGGGCGCTGAA (SEQ ID NO: 2699) | GCACTGGCATAT (SEQ ID NO: 2700) | TAGAATCAACGC (SEQ ID NO: 2701) | ATGCAGAGATCT (SEQ ID NO: 2702) | ATGGTTCACCCG (SEQ ID NO: 2703) | |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| GTTTCCGTGGTG (SEQ ID NO: 2704) | GGCATTAGTTGA (SEQ ID NO: 2705) | CACAATACACCG (SEQ ID NO: 2706) | CGTATGCCGTAC (SEQ ID NO: 2707) | TAGCGGAAGACG (SEQ ID NO: 2708) | |
| AGGAACCAGACG (SEQ ID NO: 2709) | CGGTAGTTGATC (SEQ ID NO: 2710) | GTATGACTAGCA (SEQ ID NO: 2711) | AGCCGACTCTGT (SEQ ID NO: 2712) | CCTCATGCTATT (SEQ ID NO: 2713) | |
| TAATGCCCAGGT (SEQ ID NO: 2714) | TGAAAGCGGCGA (SEQ ID NO: 2715) | ATGCTCTAGAGA (SEQ ID NO: 2716) | CTATTCTTGGCT (SEQ ID NO: 2717) | CCATCTTACCAT (SEQ ID NO: 2718) | |
| TATGAACGTCCG (SEQ ID NO: 2719) | GGTTACGGTTAC (SEQ ID NO: 2720) | AGCTAGCGTTCA (SEQ ID NO: 2721) | TCGGTAGCAACT (SEQ ID NO: 2722) | TATGCTCTCTCA (SEQ ID NO: 2723) | |
| CCACATTGGGTC (SEQ ID NO: 2724) | ACATCAGGTCAC (SEQ ID NO: 2725) | GGTCTTAGCACC (SEQ ID NO: 2726) | CCAAATGATGAC (SEQ ID NO: 2727) | CGTGTAGTAGAT (SEQ ID NO: 2728) | |
| TCAGTCAGATGA (SEQ ID NO: 2729) | GTTGATACGATG (SEQ ID NO: 2730) | TACCATCCATCT (SEQ ID NO: 2731) | GCAGGTAACATT (SEQ ID NO: 2732) | ACATGGGCGGAA (SEQ ID NO: 2733) | |
| AAGTCACACACA (SEQ ID NO: 2734) | CAGACACTTCCG (SEQ ID NO: 2735) | AGGGATGGACCA (SEQ ID NO: 2736) | GCACGTTCTACG (SEQ ID NO: 2737) | CCGCTGATGTCA (SEQ ID NO: 2738) | |
| GCTGTGATTCGA (SEQ ID NO: 2739) | TCACCATCCGAG (SEQ ID NO: 2740) | ACTAATACGCGA (SEQ ID NO: 2741) | GACTGGAGATGG (SEQ ID NO: 2742) | ACGAGTTTACCG (SEQ ID NO: 2743) | |
| CTAGCTATGGAC (SEQ ID NO: 2744) | ACCCACCACTAG (SEQ ID NO: 2745) | TCATACAGCCAG (SEQ ID NO: 2746) | ACTAAGTACCCG (SEQ ID NO: 2747) | GGAGATTGGAGA (SEQ ID NO: 2748) | |
| CTTGACGAGGTT (SEQ ID NO: 2749) | CAGAAGGTGTGG (SEQ ID NO: 2750) | GGAGGCCATAAG (SEQ ID NO: 2751) | TAAGTGAGTACC (SEQ ID NO: 2752) | AAGCCCAGCATT (SEQ ID NO: 2753) | |
| ACCTGGGAATAT (SEQ ID NO: 2754) | GAAGCTTGAATC (SEQ ID NO: 2755) | GTCCGATCCTAG (SEQ ID NO: 2756) | ATCGACAACACC (SEQ ID NO: 2757) | GGTGAAACCTAT (SEQ ID NO: 2758) | |
| CTCTGCCTAATT (SEQ ID NO: 2759) | ACTAGGATCAGT (SEQ ID NO: 2760) | CTGTGGGATTCA (SEQ ID NO: 2761) | AGCACACTACAC (SEQ ID NO: 2762) | TGGTAAGAGTCT (SEQ ID NO: 2763) | |
| ATATGACCCAGC (SEQ ID NO: 2764) | GCTCCTTAGAAG (SEQ ID NO: 2765) | TTGTCTACCTAC (SEQ ID NO: 2766) | GAATGTTGCGCT (SEQ ID NO: 2767) | GCGCTTAGAATA (SEQ ID NO: 2768) | |
| CTCTATTCCACC (SEQ ID NO: 2769) | TCCCATTCCCAT (SEQ ID NO: 2770) | GAAGGCTCCTTA (SEQ ID NO: 2771) | CGCGCAAGTATT (SEQ ID NO: 2772) | AGGTGTATCACC (SEQ ID NO: 2773) | |
| ATTGAGTGAGTC (SEQ ID NO: 2774) | TGGCGTCATTCG (SEQ ID NO: 2775) | AGATTACAACCG (SEQ ID NO: 2776) | ATAGTTAGGGCT (SEQ ID NO: 2777) | ATTGTCAAGCAG (SEQ ID NO: 2778) | |
| TTATGGTACGGA (SEQ ID NO: 2779) | AATCCTCGGAGT (SEQ ID NO: 2780) | TCTTCTGCCCTA (SEQ ID NO: 2781) | GTTCAACAGCTG (SEQ ID NO: 2782) | TTCGCAGATACG (SEQ ID NO: 2783) | |
| GCTAGTTATGGA (SEQ ID NO: 2784) | CTGGACGCATTA (SEQ ID NO: 2785) | TGAAGTCACAGT (SEQ ID NO: 2786) | TCAGCAAATGGT (SEQ ID NO: 2787) | CATAGGCCATCA (SEQ ID NO: 2788) | |
| CAGATTAACCAG (SEQ ID NO: 2789) | ACCGATTAGGTA (SEQ ID NO: 2790) | CTTAGTGCAGAA (SEQ ID NO: 2791) | AGGGACTTCAAT (SEQ ID NO: 2792) | CCTTGGAATCGC (SEQ ID NO: 2793) | |
| GGCTGCATACTC (SEQ ID NO: 2794) | ATGTGCTGCTCG (SEQ ID NO: 2795) | CATCAGTACGCC (SEQ ID NO: 2796) | GAAGTGTATCTG (SEQ ID NO: 2797) | CACTTGCTCTCT (SEQ ID NO: 2798) | |
| TTGGTAAAGTGC (SEQ ID NO: 2799) | TACGTACGAAAC (SEQ ID NO: 2800) | TAGAACACCATG (SEQ ID NO: 2801) | TCCTGTGCGAGT (SEQ ID NO: 2802) | GCAACTTCGGTA (SEQ ID NO: 2803) | |
| AAGTGGCTATCC (SEQ ID NO: 2804) | ATCACATTCTCC (SEQ ID NO: 2805) | CCGCATGACCTA (SEQ ID NO: 2806) | CCAACGTAACCA (SEQ ID NO: 2807) | GCCAATCCAACA (SEQ ID NO: 2808) | |
| AACCGATGTACC (SEQ ID NO: 2809) | AGCCTGGTACCT (SEQ ID NO: 2810) | GAGAATGGAAAG (SEQ ID NO: 2811) | AAGGTGGACAAG (SEQ ID NO: 2812) | CTGGAACATTAG (SEQ ID NO: 2813) | |
| TCGATTGGCCGT (SEQ ID NO: 2814) | GCTAAAGTCGTA (SEQ ID NO: 2815) | AACCCTAACTGG (SEQ ID NO: 2816) | CAATTGCGTGCA (SEQ ID NO: 2817) | TTAGCCCAGCGT (SEQ ID NO: 2818) | |
| GCATTACTGGAC (SEQ ID NO: 2819) | TCTCAGCGCGTA (SEQ ID NO: 2820) | TCCATACCGGAA (SEQ ID NO: 2821) | ACCAGCTCAGAT (SEQ ID NO: 2822) | AATGGTTCAGCA (SEQ ID NO: 2823) | |

TABLE 1-continued (SEQ ID NOS 775-2938, respectively, in order of appearance from left to right in each row)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TTGGGCCACATA (SEQ ID NO: 2824) | GACCCTAGACCT (SEQ ID NO: 2825) | GTTCAGACTAGC (SEQ ID NO: 2826) | ACGGTACCCTAC (SEQ ID NO: 2827) | CAGCAAGAGGAC (SEQ ID NO: 2828) | |
| CACACAAAGTCA (SEQ ID NO: 2829) | TATTCAGCGGAC (SEQ ID NO: 2830) | GACACCACAATA (SEQ ID NO: 2831) | TCATAGGGTAGT (SEQ ID NO: 2832) | CTAGTACAAGCC (SEQ ID NO: 2833) | |
| GCCAAGGATAGG (SEQ ID NO: 2834) | GTTCCGGATTAG (SEQ ID NO: 2835) | CGATTTAGGCCA (SEQ ID NO: 2836) | ATGGAGTTGTTG (SEQ ID NO: 2837) | AGAGCGGAACAA (SEQ ID NO: 2838) | |
| CGCCACGTGTAT (SEQ ID NO: 2839) | GCGTGTAATTAG (SEQ ID NO: 2840) | AGGATATTCGTG (SEQ ID NO: 2841) | CGTATCTCAGGA (SEQ ID NO: 2842) | GCAGTTGCCTCA (SEQ ID NO: 2843) | |
| GCAACCGATTGT (SEQ ID NO: 2844) | CTGTAGCTTGGC (SEQ ID NO: 2845) | CAATACGACCGT (SEQ ID NO: 2846) | TAGTTCGGTGAC (SEQ ID NO: 2847) | CGCGCCTTAAAC (SEQ ID NO: 2848) | |
| CATGTGCTTAGG (SEQ ID NO: 2849) | ATGCCTCGTAAG (SEQ ID NO: 2850) | GCCATGTGTGTA (SEQ ID NO: 2851) | CCATGGCTGTGT (SEQ ID NO: 2852) | TCCGCGCAAGTT (SEQ ID NO: 2853) | |
| GTTCCTCCATTA (SEQ ID NO: 2854) | ACCTATGGTGAA (SEQ ID NO: 2855) | GACTCCTAGACC (SEQ ID NO: 2856) | CTAGTCGCTGGT (SEQ ID NO: 2857) | TAACCACCAACG (SEQ ID NO: 2858) | |
| ACCTGTCCTTTC (SEQ ID NO: 2859) | CTGTTACAGCGA (SEQ ID NO: 2860) | AAGGCAAGAAGA (SEQ ID NO: 2861) | TCCAAGCGTCAC (SEQ ID NO: 2862) | TGCGTCAGCTAC (SEQ ID NO: 2863) | |
| GTTCACGCCCAA (SEQ ID NO: 2864) | CAGTCAGGCCTT (SEQ ID NO: 2865) | ACGAGGAGTCGA (SEQ ID NO: 2866) | GCTTCATTTCTG (SEQ ID NO: 2867) | CGAAATGCATGT (SEQ ID NO: 2868) | |
| CGATCGAACACT (SEQ ID NO: 2869) | ACTGAGCTGCAT (SEQ ID NO: 2870) | GCGGTACTACTA (SEQ ID NO: 2871) | AACTTGGCCGTA (SEQ ID NO: 2872) | ATGATCGGTACA (SEQ ID NO: 2873) | |
| CATGCCAACATG (SEQ ID NO: 2874) | ACGAAGTCTACC (SEQ ID NO: 2875) | TCAGCTGACTAG (SEQ ID NO: 2876) | CATACGATACAG (SEQ ID NO: 2877) | TTACCCGCACAG (SEQ ID NO: 2878) | |
| GAGTACAGTCTA (SEQ ID NO: 2879) | ACCGTCTTTCTC (SEQ ID NO: 2880) | ACCTGATCCGCA (SEQ ID NO: 2881) | GGTTGAGAAGAG (SEQ ID NO: 2882) | CCTGTTAGCGAA (SEQ ID NO: 2883) | |
| CCTACATGAGAC (SEQ ID NO: 2884) | AGTCTGTCTGCG (SEQ ID NO: 2885) | CAAGCTAGCTGT (SEQ ID NO: 2886) | CTGGGAGTTGTT (SEQ ID NO: 2887) | GCTCCGACCATA (SEQ ID NO: 2888) | |
| TCCGTGGTATAG (SEQ ID NO: 2889) | CCGCACTCAAGT (SEQ ID NO: 2890) | GTGGATAAACTC (SEQ ID NO: 2891) | ATCATCTCGGCG (SEQ ID NO: 2892) | ACAAATCGTTGG (SEQ ID NO: 2893) | |
| TCTACGGCACGT (SEQ ID NO: 2894) | TGTGGAAACTCC (SEQ ID NO: 2895) | GGTACAATGATC (SEQ ID NO: 2896) | ATTACCCACAGG (SEQ ID NO: 2897) | GAAGGAAAGTAG (SEQ ID NO: 2898) | |
| ATGCTGCAACAC (SEQ ID NO: 2899) | TTAGGCAGGTTC (SEQ ID NO: 2900) | ACTGTCGCAGTA (SEQ ID NO: 2901) | CACATCAGCGCT (SEQ ID NO: 2902) | ACAAACATGGTC (SEQ ID NO: 2903) | |
| TTCTCATGGAGG (SEQ ID NO: 2904) | TAAGACTACTGG (SEQ ID NO: 2905) | CATCCTGAGCAA (SEQ ID NO: 2906) | TGACCATAGTGA (SEQ ID NO: 2907) | GGACTATCGTTG (SEQ ID NO: 2908) | |
| CATAGTGATTGG (SEQ ID NO: 2909) | CGCGAAGTTTCA (SEQ ID NO: 2910) | CAACATCGTAGC (SEQ ID NO: 2911) | GATAAGCGCCTT (SEQ ID NO: 2912) | GCTATATCCAGG (SEQ ID NO: 2913) | |
| GCTATCAAGACA (SEQ ID NO: 2914) | CGATACACTGCC (SEQ ID NO: 2915) | GGCAATCATCTG (SEQ ID NO: 2916) | TAGTCTAAGGGT (SEQ ID NO: 2917) | TATTCCCACGTT (SEQ ID NO: 2918) | |
| CCGTGACAACTC (SEQ ID NO: 2919) | TTGAAATCCCGG (SEQ ID NO: 2920) | TATCGCGCGATA (SEQ ID NO: 2921) | AATTAGGCGTGT (SEQ ID NO: 2922) | CCATTAGTTCCT (SEQ ID NO: 2923) | |
| CGTTCCTTGTTA (SEQ ID NO: 2924) | GTTAGGGAGCGA (SEQ ID NO: 2925) | TACGGTCTGGAT (SEQ ID NO: 2926) | TGCTCTTGCTCT (SEQ ID NO: 2927) | TAACCTTCGCTT (SEQ ID NO: 2928) | |
| GGAATTATCGGT (SEQ ID NO: 2929) | TTACTGTGGCCG (SEQ ID NO: 2930) | TCGTTCAGGACC (SEQ ID NO: 2931) | TCCACTAGAGCA (SEQ ID NO: 2932) | GTAATCTGCCGA (SEQ ID NO: 2933) | |
| CATCAAGCATAG (SEQ ID NO: 2934) | ATATAAGGCCCA (SEQ ID NO: 2935) | TGATCCGGGTAT (SEQ ID NO: 2936) | CATTGCAAAGCA (SEQ ID NO: 2937) | GGTGGCATGGAA (SEQ ID NO: 2938) | |

TABLE 2

| | forward primer binding site fragment | 5' universal sequence fragment | barcode sequence fragment | 3' universal sequence fragment | reverse primer binding site fragment |
|---|---|---|---|---|---|
| (SEQ ID NO: 1) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 2) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 3) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 4) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 5) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 6) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 7) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 8) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 9) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 10) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 11) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 12) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 13) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 14) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 15) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 16) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 17) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 18) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 19) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 20) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 21) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 22) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 23) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 24) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 25) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 26) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 27) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 28) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 29) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 30) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 31) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 32) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 33) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 34) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 35) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 36) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 37) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 38) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 39) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 40) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 41) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 42) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 43) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 44) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 45) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 46) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 47) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 48) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 49) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 50) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 51) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 52) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 53) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 54) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 55) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 56) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 57) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 58) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 59) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 60) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 61) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 62) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 63) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 64) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 65) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 66) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 67) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 68) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 69) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 70) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 71) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 72) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 73) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 74) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 75) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 76) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 77) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 78) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 79) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 80) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 81) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 82) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 83) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 84) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 85) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 86) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 87) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 88) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 89) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 90) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 91) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 92) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 93) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 94) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 95) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 96) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 97) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 98) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 99) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 100) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 101) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 102) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 103) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 104) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 105) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 106) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 107) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 108) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 109) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 110) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 111) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 112) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 113) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 114) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 115) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 116) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 117) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 118) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 119) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 120) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 121) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 122) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 123) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 124) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 125) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 126) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 127) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 128) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 129) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 130) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 131) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 132) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 133) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 134) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 135) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 136) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 137) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 138) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 139) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 140) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 141) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 142) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 143) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 144) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 145) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 146) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 147) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 148) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 149) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 150) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 151) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 152) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 153) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 154) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 155) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 156) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 157) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 158) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 159) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 160) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 161) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 162) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 163) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 164) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 165) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 166) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 167) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 168) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 169) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 170) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 171) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 172) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 173) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 174) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 175) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 176) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 177) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 178) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 179) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 180) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 181) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 182) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 183) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 184) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 185) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 186) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 187) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 188) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 189) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 190) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 191) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 192) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 193) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 194) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 195) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 196) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 197) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 198) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 199) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 200) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 201) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 202) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 203) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 204) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 205) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 206) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 207) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 208) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 209) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 210) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 211) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 212) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 213) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 214) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 215) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 216) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 217) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 218) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 219) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 220) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 221) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 222) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 223) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 224) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 225) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 226) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 227) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 228) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 229) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 230) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 231) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 232) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 233) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 234) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 235) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 236) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 237) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 238) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 239) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 240) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 241) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 242) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 243) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 244) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 245) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 246) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 247) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 248) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 249) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 250) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 251) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 252) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 253) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 254) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 255) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 256) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 257) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 258) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 259) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 260) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 261) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 262) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 263) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 264) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 265) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 266) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 267) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 268) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 269) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 270) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 271) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 272) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 273) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 274) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 275) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 276) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 277) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 278) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 279) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 280) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 281) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 282) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 283) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 284) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 285) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 286) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 287) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 288) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 289) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 290) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 291) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 292) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 293) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 294) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 295) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 296) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 297) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 298) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 299) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 300) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 301) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 302) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 303) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 304) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 305) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 306) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 307) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 308) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 309) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 310) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 311) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 312) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 313) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 314) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 315) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 316) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 317) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 318) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 319) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 320) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 321) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 322) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 323) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 324) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 325) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 326) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 327) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 328) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 329) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 330) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 331) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 332) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 333) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 334) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 335) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 336) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 337) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 338) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 339) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 340) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 341) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 342) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 343) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 344) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 345) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 346) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 347) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 348) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 349) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 350) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 351) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 352) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 353) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 354) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 355) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 356) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 357) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 358) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 359) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 360) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 361) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 362) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 363) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 364) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 365) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 366) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 367) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 368) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 369) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 370) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 371) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 372) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 373) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 374) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 375) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 376) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 377) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 378) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 379) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 380) | CCTACGGGAGGCATCAG | **GCAGATCTCG** | CCTACGGGAGGCATCAG | **AGTCAGTCAGCC** | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 381) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 382) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 383) | CCTACGGGAGGCATCAG | **GCAGATCTCG** | CCTACGGGAGGCATCAG | **AGTCAGTCAGCC** | GGATTAGATACCCTAGTAGTC |
| (SEQ ID NO: 384) | CCTACGGGAGGCATCAG | **GCAGATCTCG** | CCTACGGGAGGCATCAG | **AGTCAGTCAGCC** | GGATTAGATACCCTAGTAGTC |

In one illustrative aspect, the control composition for sequencing or chemical analyses comprises a nucleic acid construct comprising at least one barcode sequence fragment linked at its 5' or 3' end to at least one universal sequence fragment. In another embodiment, the nucleic acid construct comprises at least a first and a second universal sequence fragment, and the first universal sequence fragment can be linked to the 5' end of the barcode sequence fragment and the second universal sequence fragment can be linked to the 3' end of the barcode sequence fragment. In one aspect, the universal sequence fragments can be extended as needed to make the nucleic acid construct longer for different applications such as whole genome sequencing where short inserts may be lost.

In yet another embodiment, a universal sequence fragment is not included in the nucleic acid construct (e.g., for microarray applications). In this microarray embodiment, primer binding site fragments are also not included. The complimentary sequence to each barcode sequence fragment may be spotted onto the microarray alongside nucleic acid sequences of interest to detect the barcode sequence fragments. The barcode sequence fragment detected would be in a fixed location that would identify which barcode sequence fragment was present.

In various embodiments, the universal sequence fragments can be from about 10 base pairs in length to about 270 base pairs in length, from about 10 base pairs in length to about 260 base pairs in length, from about 10 base pairs in length to about 250 base pairs in length, from about 10 base pairs in length to about 240 base pairs in length, from about 10 base pairs in length to about 230 base pairs in length, from about 10 base pairs in length to about 220 base pairs in length, from about 10 base pairs in length to about 210 base pairs in length, from about 10 base pairs in length to about 200 base pairs in length, from about 10 base pairs in length to about 190 base pairs in length, from about 10 base pairs in length to about 180 base pairs in length, from about 10 base pairs in length to about 170 base pairs in length, from about 10 base pairs in length to about 160 base pairs in length, from about 10 base pairs in length to about 150 base pairs in length, from about 10 base pairs in length to about 140 base pairs in length, from about 10 base pairs in length to about 130 base pairs in length, from about 10 base pairs in length to about 120 base pairs in length, from about 10 base pairs in length to about 110 base pairs in length, from about 10 base pairs in length to about 100 base pairs in length, from about 10 base pairs in length to about 90 base pairs in length, from about 10 base pairs in length to about 80 base pairs in length, from about 10 base pairs in length to about 70 base pairs in length, from about 10 base pairs in length to about 60 base pairs in length, from about 10 base pairs in length to about 50 base pairs in length, from about 10 base pairs in length to about 40 base pairs in length, from about 10 base pairs in length to about 30 base pairs in length, from about 10 base pairs in length to about 20 base pairs in length, from about 10 base pairs in length to about 15 base pairs in length, from about 8 base pairs in length to about 15 base pairs in length, or from about 8 base pairs in length to about 12 base pairs in length.

Figure 5:
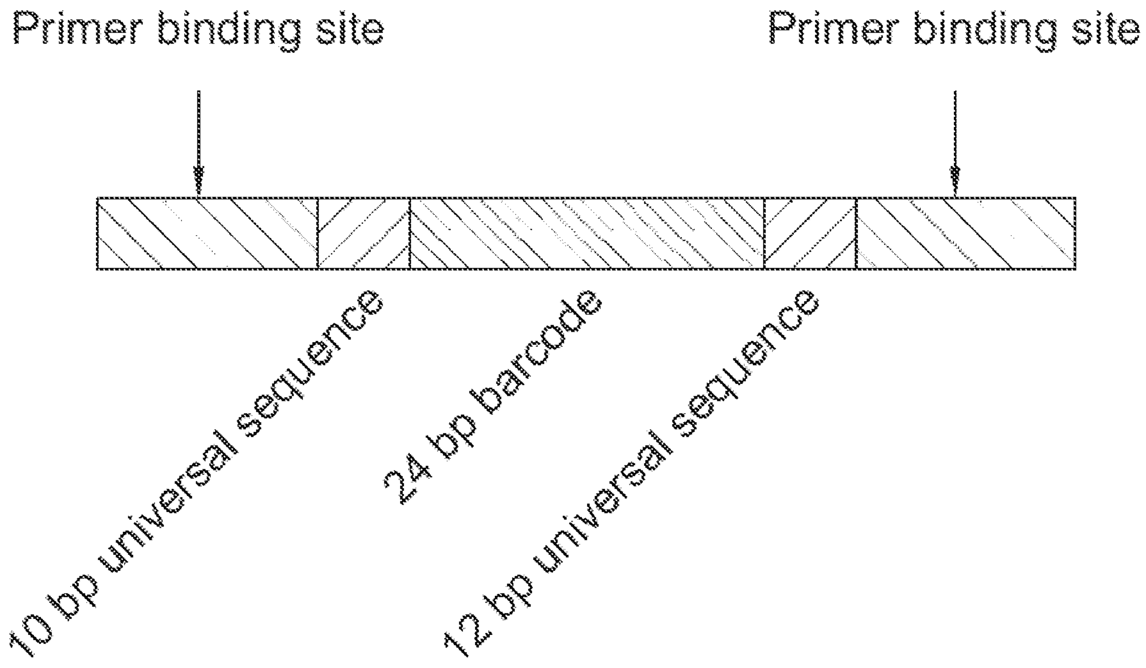
FIG. 5 shows schematically an exemplary nucleic acid construct as described herein comprising the unique barcode sequence fragment (e.g., 24 bases) that is not present in any known genome. The exemplary nucleic acid construct also comprises 10 bp and 12 bp universal sequence fragments and primer binding sites at the 5' and 3' ends of the nucleic acid construct.
Figure 7A:
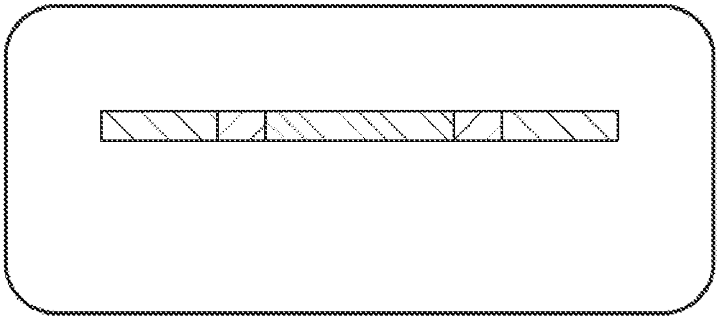
FIGS. 7A-7B show schematically the direct encapsulation of exemplary nucleic acid constructs as described herein without a plasmid or genome backbone. In various embodiments, the nucleic acid construct comprises (FIG. 7A) or lacks (FIG. 7B) primer binding site sequence fragments.
Figure 7B:
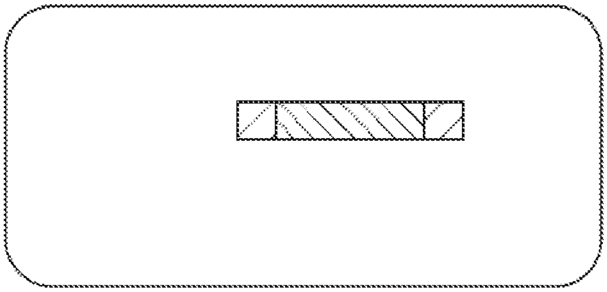

In embodiments for amplicon sequencing or chemical analyses involving amplicon sequencing to detect the nucleic acid construct of the control composition, the nucleic acid construct can further comprise at least a first and a second primer binding site fragment. In this aspect, the primers can be any primers of interest. In this embodiment, the first primer binding site fragment is linked at its 3' end to the 5' end of the first universal sequence fragment and the second primer binding site fragment is linked at its 5' end to the 3' end of the second universal sequence fragment (see FIG. 5 for an example). In embodiments for whole genome sequencing, the nucleic acid construct may lack primer binding site fragments (see FIG. 7B for an example). In embodiments where primer binding site fragments are included in the nucleic acid construct, the primer binding site fragments can range in length from about 15 base pairs to about 28 base pairs, from about 15 base pairs to about 26 base pairs, from about 15 base pairs to about 24 base pairs, from about 15 base pairs to about 22 base pairs, from about 15 base pairs to about 20 base pairs, from about 16 base pairs to about 22 base pairs, from about 16 base pairs to about 20 base pairs, from about 17 base pairs to about 20 base pairs, or can be about 18 base pairs.

In all of the various embodiments described above, the entire nucleic acid construct, not including plasmid sequence if a plasmid is present, can range in length from about 80 base pairs to about 300 base pairs, from about 80 base pairs to about 290 base pairs, from about 80 base pairs to about 280 base pairs, from about 80 base pairs to about 270 base pairs, from about 80 base pairs to about 260 base pairs, from about 80 base pairs to about 250 base pairs, from about 80 base pairs to about 240 base pairs, from about 80 base pairs to about 230 base pairs, from about 80 base pairs to about 220 base pairs, from about 80 base pairs to about 210 base pairs, from about 80 base pairs to about 200 base pairs, from about 80 base pairs to about 190 base pairs, from about 80 base pairs to about 180 base pairs, from about 80 base pairs to about 170 base pairs, or from about 80 base pairs to about 160 base pairs.

Various embodiments of the nucleic acid constructs, including the forward and reverse primer binding site fragments, the 5' and 3' universal sequence fragments, and the barcode sequence fragment are shown in Table 2 above having SEQ ID NOS: 1 to 384. The corresponding full sequences are also shown as SEQ ID NOS: 385 to 768 in Table 3 below. These embodiments have primer binding site sequence fragments similar to the nucleic acid construct exemplified in FIG. 5.

TABLE 3

| | full sequence |
|---|---|
| (SEQ ID NO: 385) | CCTACGGGAGGCATCAGGCAGATCTCGTCCCTTGTCTCCACGAGACTGATTAGTCAGTCAGCCGGATTAGATACCCTAGTAGTC |
| (SEQ ID NO: 386) | CCTACGGGAGGCATCAGGCAGATCTCGGCTGTACGGATTATCACCAGGTGTAGTCAGTCAGCCGGATTAGATACCCTAGTAGTC |
| (SEQ ID NO: 387) | CCTACGGGAGGCATCAGGCAGATCTCGTGGTCAACGATACATCGCGTTGACAGTCAGTCAGCCGGATTAGATACCCTAGTAGTC |
| (SEQ ID NO: 388) | CCTACGGGAGGCATCAGGCAGATCTCGATCGCACAGTAAGCACATAGTCGTAGTCAGTCAGCCGGATTAGATACCCTAGTAGTC |
| (SEQ ID NO: 389) | CCTACGGGAGGCATCAGGCAGATCTCGGTCGTGTAGCCTGGCAAATACACTAGTCAGTCAGCCGGATTAGATACCCTAGTAGTC |
| (SEQ ID NO: 390) | CCTACGGGAGGCATCAGGCAGATCTCGAGCGGAGGTTAGGTCATGCTCCAGAGTCAGTCAGCCGGATTAGATACCCTAGTAGTC |
| (SEQ ID NO: 391) | CCTACGGGAGGCATCAGGCAGATCTCGATCCTTTGGTTCCCTAGTAAGCTGAGTCAGTCAGCCGGATTAGATACCCTAGTAGTC |
| (SEQ ID NO: 392) | CCTACGGGAGGCATCAGGCAGATCTCGTACAGCGCATACTTACCGACGAGTAGTCAGTCAGCCGGATTAGATACCCTAGTAGTC |
| (SEQ ID NO: 393) | CCTACGGGAGGCATCAGGCAGATCTCGACCGGTATGTACGCTTAGATGTAGAGTCAGTCAGCCGGATTAGATACCCTAGTAGTC |
| (SEQ ID NO: 394) | CCTACGGGAGGCATCAGGCAGATCTCGAATTGTGTCGGAAAGACGTAGCGGAGTCAGTCAGCCGGATTAGATACCCTAGTAGTC |
| (SEQ ID NO: 395) | CCTACGGGAGGCATCAGGCAGATCTCGTGCATACACTGGTTACCTTACACCAGTCAGTCAGCCGGATTAGATACCCTAGTAGTC |
| (SEQ ID NO: 396) | CCTACGGGAGGCATCAGGCAGATCTCGAGTCGAACGAGGTGACTAATGGCCAGTCAGTCAGCCGGATTAGATACCCTAGTAGTC |
| (SEQ ID NO: 397) | CCTACGGGAGGCATCAGGCAGATCTCGACCAGTGACTCACTCTCTCACTTGAGTCAGTCAGCCGGATTAGATACCCTAGTAGTC |
| (SEQ ID NO: 398) | CCTACGGGAGGCATCAGGCAGATCTCGGAATACCAAGTCATTGCAAGCAACAGTCAGTCAGCCGGATTAGATACCCTAGTAGTC |
| (SEQ ID NO: 399) | CCTACGGGAGGCATCAGGCAGATCTCGGTAGATCGTGTACACGTGACATGTAGTCAGTCAGCCGGATTAGATACCCTAGTAGTC |
| (SEQ ID NO: 400) | CCTACGGGAGGCATCAGGCAGATCTCGTAACGTGTGTGCCACAGTTGAAGTAGTCAGTCAGCCGGATTAGATACCCTAGTAGTC |
| (SEQ ID NO: 401) | CCTACGGGAGGCATCAGGCAGATCTCGCATTATGGCGTGCTAGGATCACTGAGTCAGTCAGCCGGATTAGATACCCTAGTAGTC |
| (SEQ ID NO: 402) | CCTACGGGAGGCATCAGGCAGATCTCGCCAATACGCCTGGATGACCCAAATAGTCAGTCAGCCGGATTAGATACCCTAGTAGTC |
| (SEQ ID NO: 403) | CCTACGGGAGGCATCAGGCAGATCTCGGATCTGCGATCCACCGGAGTAGGAAGTCAGTCAGCCGGATTAGATACCCTAGTAGTC |
| (SEQ ID NO: 404) | CCTACGGGAGGCATCAGGCAGATCTCGCAGCTCATCAGCTGAGGACTACCTAGTCAGTCAGCCGGATTAGATACCCTAGTAGTC |
| (SEQ ID NO: 405) | CCTACGGGAGGCATCAGGCAGATCTCGCAAACAACAGCTCAATCGGCTTGCAGTCAGTCAGCCGGATTAGATACCCTAGTAGTC |
| (SEQ ID NO: 406) | CCTACGGGAGGCATCAGGCAGATCTCGGCAACACCATCCAACACTCGATCGAGTCAGTCAGCCGGATTAGATACCCTAGTAGTC |
| (SEQ ID NO: 407) | CCTACGGGAGGCATCAGGCAGATCTCGGCGATATATCGCTGACCGGCTGTTAGTCAGTCAGCCGGATTAGATACCCTAGTAGTC |
| (SEQ ID NO: 408) | CCTACGGGAGGCATCAGGCAGATCTCGCGAGCAATCCTAGGAGGAGCAATAAGTCAGTCAGCCGGATTAGATACCCTAGTAGTC |
| (SEQ ID NO: 409) | CCTACGGGAGGCATCAGGCAGATCTCGAGTCGTGCACATAGCGACGAAGACAGTCAGTCAGCCGGATTAGATACCCTAGTAGTC |
| (SEQ ID NO: 410) | CCTACGGGAGGCATCAGGCAGATCTCGGTATCTGCGCGTCTTCCCTAACTCAGTCAGTCAGCCGGATTAGATACCCTAGTAGTC |
| (SEQ ID NO: 411) | CCTACGGGAGGCATCAGGCAGATCTCGCGAGGGAAAGTCTGGAAGAACGGCAGTCAGTCAGCCGGATTAGATACCCTAGTAGTC |
| (SEQ ID NO: 412) | CCTACGGGAGGCATCAGGCAGATCTCGCAAATTCGGGATGCTAGACACTACAGTCAGTCAGCCGGATTAGATACCCTAGTAGTC |
| (SEQ ID NO: 413) | CCTACGGGAGGCATCAGGCAGATCTCGAGATTGACCAACTTGGATTGAACGAGTCAGTCAGCCGGATTAGATACCCTAGTAGTC |
| (SEQ ID NO: 414) | CCTACGGGAGGCATCAGGCAGATCTCGAGTTACGAGCTAGATATACCAGTGAGTCAGTCAGCCGGATTAGATACCCTAGTAGTC |
| (SEQ ID NO: 415) | CCTACGGGAGGCATCAGGCAGATCTCGGCATATGCACTGAACAAACTGCCAAGTCAGTCAGCCGGATTAGATACCCTAGTAGTC |
| (SEQ ID NO: 416) | CCTACGGGAGGCATCAGGCAGATCTCGCAACTCCCGTGAGTAGACATGTGTAGTCAGTCAGCCGGATTAGATACCCTAGTAGTC |
| (SEQ ID NO: 417) | CCTACGGGAGGCATCAGGCAGATCTCGTTGCGTTAGCAGTACAGTTACGCGAGTCAGTCAGCCGGATTAGATACCCTAGTAGTC |
| (SEQ ID NO: 418) | CCTACGGGAGGCATCAGGCAGATCTCGTACGAGCCCTAACAAGCCCTAGTAAGTCAGTCAGCCGGATTAGATACCCTAGTAGTC |
| (SEQ ID NO: 419) | CCTACGGGAGGCATCAGGCAGATCTCGCACTACGCTAGATAGTGTCGGATCAGTCAGTCAGCCGGATTAGATACCCTAGTAGTC |
| (SEQ ID NO: 420) | CCTACGGGAGGCATCAGGCAGATCTCGTGCAGTCCTCGACTGAGCTCTGCAAGTCAGTCAGCCGGATTAGATACCCTAGTAGTC |
| (SEQ ID NO: 421) | CCTACGGGAGGCATCAGGCAGATCTCGACCATAGCTCCGCTTCGACTTTCCAGTCAGTCAGCCGGATTAGATACCCTAGTAGTC |
| (SEQ ID NO: 422) | CCTACGGGAGGCATCAGGCAGATCTCGTCGACATCTCTTGTCATAAGAACCAGTCAGTCAGCCGGATTAGATACCCTAGTAGTC |
| (SEQ ID NO: 423) | CCTACGGGAGGCATCAGGCAGATCTCGGAACACTTTGGAGTCCGCAAGTTAAGTCAGTCAGCCGGATTAGATACCCTAGTAGTC |

TABLE 3-continued

| | full sequence |
|---|---|
| (SEQ ID NO: 424) | CCTACGGGAGGCATCAGGCAGATCTCGGAGCCATCTGTACGTAGAGCTCTCAGTCAGTCAGCCGGATTAGATACCCTAGTAGTC |
| (SEQ ID NO: 425) | CCTACGGGAGGCATCAGGCAGATCTCGTTGGGTACACGTCCTCTGAGAGCTAGTCAGTCAGCCGGATTAGATACCCTAGTAGTC |
| (SEQ ID NO: 426) | CCTACGGGAGGCATCAGGCAGATCTCGAAGGCGCTCCTTCCTCGATGCAGTAGTCAGTCAGCCGGATTAGATACCCTAGTAGTC |
| (SEQ ID NO: 427) | CCTACGGGAGGCATCAGGCAGATCTCGTAATACGGATCGGCGGACTATTCAAGTCAGTCAGCCGGATTAGATACCCTAGTAGTC |
| (SEQ ID NO: 428) | CCTACGGGAGGCATCAGGCAGATCTCGTCGGAATTAGACCGTGCACAATTGAGTCAGTCAGCCGGATTAGATACCCTAGTAGTC |
| (SEQ ID NO: 429) | CCTACGGGAGGCATCAGGCAGATCTCGTGTGAATTCGGACGGCCTAAGTTCAGTCAGTCAGCCGGATTAGATACCCTAGTAGTC |
| (SEQ ID NO: 430) | CCTACGGGAGGCATCAGGCAGATCTCGCATTCGTGGCGTAGCGCTCACATCAGTCAGTCAGCCGGATTAGATACCCTAGTAGTC |
| (SEQ ID NO: 431) | CCTACGGGAGGCATCAGGCAGATCTCGTACTACGTGGCCTGGTTATGGCACAGTCAGTCAGCCGGATTAGATACCCTAGTAGTC |
| (SEQ ID NO: 432) | CCTACGGGAGGCATCAGGCAGATCTCGGGCCAGTTCCTACGAGGTTCTGATAGTCAGTCAGCCGGATTAGATACCCTAGTAGTC |
| (SEQ ID NO: 433) | CCTACGGGAGGCATCAGGCAGATCTCGGATGTTCGCTAGAACTCCTGTGGAAGTCAGTCAGCCGGATTAGATACCCTAGTAGTC |
| (SEQ ID NO: 434) | CCTACGGGAGGCATCAGGCAGATCTCGCTATCTCCTGTCTAATGGTCGTAGAGTCAGTCAGCCGGATTAGATACCCTAGTAGTC |
| (SEQ ID NO: 435) | CCTACGGGAGGCATCAGGCAGATCTCGACTCACAGGAATTTGCACCGTCGAAGTCAGTCAGCCGGATTAGATACCCTAGTAGTC |
| (SEQ ID NO: 436) | CCTACGGGAGGCATCAGGCAGATCTCGATGATGAGCCTCTGCTACAGACGTAGTCAGTCAGCCGGATTAGATACCCTAGTAGTC |
| (SEQ ID NO: 437) | CCTACGGGAGGCATCAGGCAGATCTCGGTCGACAGAGGAATGGCCTGACTAAGTCAGTCAGCCGGATTAGATACCCTAGTAGTC |
| (SEQ ID NO: 438) | CCTACGGGAGGCATCAGGCAGATCTCGTGTCGCAAATAGACGCACATACAAAGTCAGTCAGCCGGATTAGATACCCTAGTAGTC |
| (SEQ ID NO: 439) | CCTACGGGAGGCATCAGGCAGATCTCGCATCCCTCTACTTGAGTGGTCTGTAGTCAGTCAGCCGGATTAGATACCCTAGTAGTC |
| (SEQ ID NO: 440) | CCTACGGGAGGCATCAGGCAGATCTCGTATACCGCTGCGGATAGCACTCGTAGTCAGTCAGCCGGATTAGATACCCTAGTAGTC |
| (SEQ ID NO: 441) | CCTACGGGAGGCATCAGGCAGATCTCGAGTTGAGGCATTTAGCGCGAACTTAGTCAGTCAGCCGGATTAGATACCCTAGTAGTC |
| (SEQ ID NO: 442) | CCTACGGGAGGCATCAGGCAGATCTCGACAATAGACACCCATACACGCACCAGTCAGTCAGCCGGATTAGATACCCTAGTAGTC |
| (SEQ ID NO: 443) | CCTACGGGAGGCATCAGGCAGATCTCGCGGTCAATTGACACCTCAGTCAAGAGTCAGTCAGCCGGATTAGATACCCTAGTAGTC |
| (SEQ ID NO: 444) | CCTACGGGAGGCATCAGGCAGATCTCGGTGGAGTCTCATTCGACCAAACACAGTCAGTCAGCCGGATTAGATACCCTAGTAGTC |
| (SEQ ID NO: 445) | CCTACGGGAGGCATCAGGCAGATCTCGGCTCGAAGATTCCCACCCAGTAACAGTCAGTCAGCCGGATTAGATACCCTAGTAGTC |
| (SEQ ID NO: 446) | CCTACGGGAGGCATCAGGCAGATCTCGAGGCTTACGTGTATATCGCGATGAAGTCAGTCAGCCGGATTAGATACCCTAGTAGTC |
| (SEQ ID NO: 447) | CCTACGGGAGGCATCAGGCAGATCTCGTCTCTACCACTCCGCCGGTAATCTAGTCAGTCAGCCGGATTAGATACCCTAGTAGTC |
| (SEQ ID NO: 448) | CCTACGGGAGGCATCAGGCAGATCTCGACTTCCAACTTCCCGATGCCTTGAAGTCAGTCAGCCGGATTAGATACCCTAGTAGTC |
| (SEQ ID NO: 449) | CCTACGGGAGGCATCAGGCAGATCTCGCTCACCTAGGAAAGCAGGCACGAAAGTCAGTCAGCCGGATTAGATACCCTAGTAGTC |
| (SEQ ID NO: 450) | CCTACGGGAGGCATCAGGCAGATCTCGGTGTTGTCGTGCTACGCAGCACTAAGTCAGTCAGCCGGATTAGATACCCTAGTAGTC |
| (SEQ ID NO: 451) | CCTACGGGAGGCATCAGGCAGATCTCGCCACAGATCGATCGCTTAGTGCTGAGTCAGTCAGCCGGATTAGATACCCTAGTAGTC |
| (SEQ ID NO: 452) | CCTACGGGAGGCATCAGGCAGATCTCGTATCGACACAAGCAAAGTTTGCGAAGTCAGTCAGCCGGATTAGATACCCTAGTAGTC |
| (SEQ ID NO: 453) | CCTACGGGAGGCATCAGGCAGATCTCGGATTCCGGCTCATCGAGCCGATCTAGTCAGTCAGCCGGATTAGATACCCTAGTAGTC |
| (SEQ ID NO: 454) | CCTACGGGAGGCATCAGGCAGATCTCGCGTAATTGCCGCCTCATCATGTTCAGTCAGTCAGCCGGATTAGATACCCTAGTAGTC |
| (SEQ ID NO: 455) | CCTACGGGAGGCATCAGGCAGATCTCGGGTGACTAGTTCCCAGGGACTTCTAGTCAGTCAGCCGGATTAGATACCCTAGTAGTC |
| (SEQ ID NO: 456) | CCTACGGGAGGCATCAGGCAGATCTCGATGGGTTCCGTCGCAATCCTTGCGAGTCAGTCAGCCGGATTAGATACCCTAGTAGTC |
| (SEQ ID NO: 457) | CCTACGGGAGGCATCAGGCAGATCTCGTAGGCATGCTTGCCTGCTTCCTTCAGTCAGTCAGCCGGATTAGATACCCTAGTAGTC |
| (SEQ ID NO: 458) | CCTACGGGAGGCATCAGGCAGATCTCGAACTAGTTCAGGCAAGGCACAAGGAGTCAGTCAGCCGGATTAGATACCCTAGTAGTC |
| (SEQ ID NO: 459) | CCTACGGGAGGCATCAGGCAGATCTCGATTCTGCCGAAGGGCCTATAAGTCAGTCAGTCAGCCGGATTAGATACCCTAGTAGTC |
| (SEQ ID NO: 460) | CCTACGGGAGGCATCAGGCAGATCTCGAGCATGTCCCGTTCCATTTCATGCAGTCAGTCAGCCGGATTAGATACCCTAGTAGTC |
| (SEQ ID NO: 461) | CCTACGGGAGGCATCAGGCAGATCTCGGTACGATATGACTCGGCGATCATCAGTCAGTCAGCCGGATTAGATACCCTAGTAGTC |
| (SEQ ID NO: 462) | CCTACGGGAGGCATCAGGCAGATCTCGGTGGTGGTTTCCGTTTCACGCGAAAGTCAGTCAGCCGGATTAGATACCCTAGTAGTC |

TABLE 3-continued

| | full sequence |
|---|---|
| (SEQ ID NO: 463) | CCTACGGGAGGCATCAGGCAGATCTCGTAGTATGCGCAAACAAGAACCTTGAGTCAGTCAGCCGGATTAGATACCCTAGTAGTC |
| (SEQ ID NO: 464) | CCTACGGGAGGCATCAGGCAGATCTCGTGCGCTGAATGTTACTCTCTTAGCAGTCAGTCAGCCGGATTAGATACCCTAGTAGTC |
| (SEQ ID NO: 465) | CCTACGGGAGGCATCAGGCAGATCTCGATGGCTGTCAGTAACTGTTCGCGCAGTCAGTCAGCCGGATTAGATACCCTAGTAGTC |
| (SEQ ID NO: 466) | CCTACGGGAGGCATCAGGCAGATCTCGGTTCTCTTCTCGCGAAGCATCTACAGTCAGTCAGCCGGATTAGATACCCTAGTAGTC |
| (SEQ ID NO: 467) | CCTACGGGAGGCATCAGGCAGATCTCGCGTAAGATGCCTGTTTGGCCACACAGTCAGTCAGCCGGATTAGATACCCTAGTAGTC |
| (SEQ ID NO: 468) | CCTACGGGAGGCATCAGGCAGATCTCGGCGTTCTAGCTGTCAGGTTGCCCAAGTCAGTCAGCCGGATTAGATACCCTAGTAGTC |
| (SEQ ID NO: 469) | CCTACGGGAGGCATCAGGCAGATCTCGGTTGTTCTGGGATCATTCCACTCAAGTCAGTCAGCCGGATTAGATACCCTAGTAGTC |
| (SEQ ID NO: 470) | CCTACGGGAGGCATCAGGCAGATCTCGGGACTTCCAGCTGTCACATCACGAAGTCAGTCAGCCGGATTAGATACCCTAGTAGTC |
| (SEQ ID NO: 471) | CCTACGGGAGGCATCAGGCAGATCTCGCTCACAACCGTGCGACATTTCTCTAGTCAGTCAGCCGGATTAGATACCCTAGTAGTC |
| (SEQ ID NO: 472) | CCTACGGGAGGCATCAGGCAGATCTCGCTGCTATTCCTCGGACGTTAACTAAGTCAGTCAGCCGGATTAGATACCCTAGTAGTC |
| (SEQ ID NO: 473) | CCTACGGGAGGCATCAGGCAGATCTCGATGTCACCGCTGTAGCAGTTGCGTAGTCAGTCAGCCGGATTAGATACCCTAGTAGTC |
| (SEQ ID NO: 474) | CCTACGGGAGGCATCAGGCAGATCTCGTGTAACGCCGATCACGCTATTGGAAGTCAGTCAGCCGGATTAGATACCCTAGTAGTC |
| (SEQ ID NO: 475) | CCTACGGGAGGCATCAGGCAGATCTCGAGCAGAACATCTAACTTCACTTCCAGTCAGTCAGCCGGATTAGATACCCTAGTAGTC |
| (SEQ ID NO: 476) | CCTACGGGAGGCATCAGGCAGATCTCGTGGAGTAGGTGGCCAGTGGATATAAGTCAGTCAGCCGGATTAGATACCCTAGTAGTC |
| (SEQ ID NO: 477) | CCTACGGGAGGCATCAGGCAGATCTCGTTGGCTCTATTCTGTGTGTAACGCAGTCAGTCAGCCGGATTAGATACCCTAGTAGTC |
| (SEQ ID NO: 478) | CCTACGGGAGGCATCAGGCAGATCTCGGATCCCACGTACCCAATCGTGCAAAGTCAGTCAGCCGGATTAGATACCCTAGTAGTC |
| (SEQ ID NO: 479) | CCTACGGGAGGCATCAGGCAGATCTCGTACCGCTTCTTCAGGCTAGCAGAGAGTCAGTCAGCCGGATTAGATACCCTAGTAGTC |
| (SEQ ID NO: 480) | CCTACGGGAGGCATCAGGCAGATCTCGTGTGCGATAACAGTCACTCCGAACAGTCAGTCAGCCGGATTAGATACCCTAGTAGTC |
| (SEQ ID NO: 481) | CCTACGGGAGGCATCAGGCAGATCTCGGATTATCGACGACACCGAAATCTGAGTCAGTCAGCCGGATTAGATACCCTAGTAGTC |
| (SEQ ID NO: 482) | CCTACGGGAGGCATCAGGCAGATCTCGGCCTAGCCCAATTGACGTAGAACTAGTCAGTCAGCCGGATTAGATACCCTAGTAGTC |
| (SEQ ID NO: 483) | CCTACGGGAGGCATCAGGCAGATCTCGGATGTATGTGGTCTATGCCGGCTAAGTCAGTCAGCCGGATTAGATACCCTAGTAGTC |
| (SEQ ID NO: 484) | CCTACGGGAGGCATCAGGCAGATCTCGACTCCTTGTGTTGTGGTATGGGAGAGTCAGTCAGCCGGATTAGATACCCTAGTAGTC |
| (SEQ ID NO: 485) | CTACGGGAGGCATCAGGCAGATCTCGGTCACGGACATTTGTACCAACCGAAGTCAGTCAGCCGGATTAGATACCCTAGTAGTC |
| (SEQ ID NO: 486) | CCTACGGGAGGCATCAGGCAGATCTCGGCGAGCGAAGTAAGGGTACAGGGTAGTCAGTCAGCCGGATTAGATACCCTAGTAGTC |
| (SEQ ID NO: 487) | CCTACGGGAGGCATCAGGCAGATCTCGATCTACCGAAGCAGAGTGCTAATCAGTCAGTCAGCCGGATTAGATACCCTAGTAGTC |
| (SEQ ID NO: 488) | CCTACGGGAGGCATCAGGCAGATCTCGACTTGGTGTAAGTTGGCGGGTTATAGTCAGTCAGCCGGATTAGATACCCTAGTAGTC |
| (SEQ ID NO: 489) | CCTACGGGAGGCATCAGGCAGATCTCGTCTTGGAGGTCACACGATGGTCATAGTCAGTCAGCCGGATTAGATACCCTAGTAGTC |
| (SEQ ID NO: 490) | CCTACGGGAGGCATCAGGCAGATCTCGTCACCTCCTTGTGTCACCAATCCGAGTCAGTCAGCCGGATTAGATACCCTAGTAGTC |
| (SEQ ID NO: 491) | CCTACGGGAGGCATCAGGCAGATCTCGGCACACCTGATACACTAACAAACGAGTCAGTCAGCCGGATTAGATACCCTAGTAGTC |
| (SEQ ID NO: 492) | CCTACGGGAGGCATCAGGCAGATCTCGGCGACAATTACATTCCAGGCAGATAGTCAGTCAGCCGGATTAGATACCCTAGTAGTC |
| (SEQ ID NO: 493) | CCTACGGGAGGCATCAGGCAGATCTCGTCATGCTCCATTTATGGTACCCAGAGTCAGTCAGCCGGATTAGATACCCTAGTAGTC |
| (SEQ ID NO: 494) | CCTACGGGAGGCATCAGGCAGATCTCGAGCTGTCAAGCTCACGACTTGACAAGTCAGTCAGCCGGATTAGATACCCTAGTAGTC |
| (SEQ ID NO: 495) | CTACGGGAGGCATCAGGCAGATCTCGGAGAGCAACAGACTTGGAGGCTTAAGTCAGTCAGCCGGATTAGATACCCTAGTAGTC |
| (SEQ ID NO: 496) | CCTACGGGAGGCATCAGGCAGATCTCGTACTCGGGAACTACGTGGTTCCACAGTCAGTCAGCCGGATTAGATACCCTAGTAGTC |
| (SEQ ID NO: 497) | CCTACGGGAGGCATCAGGCAGATCTCGCGTGCTTAGGCTGACGCTTTGCTGAGTCAGTCAGCCGGATTAGATACCCTAGTAGTC |
| (SEQ ID NO: 498) | CCTACGGGAGGCATCAGGCAGATCTCGTACCGAAGGTATACAGGGTTTGTAAGTCAGTCAGCCGGATTAGATACCCTAGTAGTC |
| (SEQ ID NO: 499) | CCTACGGGAGGCATCAGGCAGATCTCGCACTCATCATTCGCCTATGAGATCAGTCAGTCAGCCGGATTAGATACCCTAGTAGTC |
| (SEQ ID NO: 500) | CCTACGGGAGGCATCAGGCAGATCTCGGTATTTCGGACGCAAACCTATGGCAGTCAGTCAGCCGGATTAGATACCCTAGTAGTC |
| (SEQ ID NO: 501) | CCTACGGGAGGCATCAGGCAGATCTCGTATCTATCCTGCATCGCTTAAGGCAGTCAGTCAGCCGGATTAGATACCCTAGTAGTC |

TABLE 3-continued

| | full sequence |
|---|---|
| (SEQ ID NO: 502) | CCTACGGGAGGCATCAGGCAGATCTCGTTGCCAAGAGTCACCATCCAACGAAGTCAGTCAGCCGGATTAGATACCCTAGTAGTC |
| (SEQ ID NO: 503) | CCTACGGGAGGCATCAGGCAGATCTCGAGTAGCGGAAGAGCAATAGGAGGAAGTCAGTCAGCCGGATTAGATACCCTAGTAGTC |
| (SEQ ID NO: 504) | CCTACGGGAGGCATCAGGCAGATCTCGGCAATTAGGTACCCGAACGTCACTAGTCAGTCAGCCGGATTAGATACCCTAGTAGTC |
| (SEQ ID NO: 505) | CCTACGGGAGGCATCAGGCAGATCTCGCATACCGTGAGTACACCAACACCAAGTCAGTCAGCCGGATTAGATACCCTAGTAGTC |
| (SEQ ID NO: 506) | CCTACGGGAGGCATCAGGCAGATCTCGATGTGTGTAGACCCATCACATAGGAGTCAGTCAGCCGGATTAGATACCCTAGTAGTC |
| (SEQ ID NO: 507) | CCTACGGGAGGCATCAGGCAGATCTCGCCTGCGAAGTATCGACACGGAGAAAGTCAGTCAGCCGGATTAGATACCCTAGTAGTC |
| (SEQ ID NO: 508) | CCTACGGGAGGCATCAGGCAGATCTCGTTCTCTCGACATGAACCTATGACAAGTCAGTCAGCCGGATTAGATACCCTAGTAGTC |
| (SEQ ID NO: 509) | CCTACGGGAGGCATCAGGCAGATCTCGGCTCTCCGTAGAATGCCGGTAATAAGTCAGTCAGCCGGATTAGATACCCTAGTAGTC |
| (SEQ ID NO: 510) | CCTACGGGAGGCATCAGGCAGATCTCGGTTAAGCTGACCGAACAGCTCTACAGTCAGTCAGCCGGATTAGATACCCTAGTAGTC |
| (SEQ ID NO: 511) | CCTACGGGAGGCATCAGGCAGATCTCGATGCCATGCCGTGTGAGTCATACCAGTCAGTCAGCCGGATTAGATACCCTAGTAGTC |
| (SEQ ID NO: 512) | CCTACGGGAGGCATCAGGCAGATCTCGGACATTGTCACGTGGCCGTTACTGAGTCAGTCAGCCGGATTAGATACCCTAGTAGTC |
| (SEQ ID NO: 513) | CCTACGGGAGGCATCAGGCAGATCTCGGCCAACAACCATTAGAGCTGCCATAGTCAGTCAGCCGGATTAGATACCCTAGTAGTC |
| (SEQ ID NO: 514) | CCTACGGGAGGCATCAGGCAGATCTCGATCAGTACTAGGATCTAGTGGCAAAGTCAGTCAGCCGGATTAGATACCCTAGTAGTC |
| (SEQ ID NO: 515) | CCTACGGGAGGCATCAGGCAGATCTCGTCCTCGAGCGATCCTTCAATGGGAAGTCAGTCAGCCGGATTAGATACCCTAGTAGTC |
| (SEQ ID NO: 516) | CCTACGGGAGGCATCAGGCAGATCTCGACCCAAGCGTTATTGACGACATCGAGTCAGTCAGCCGGATTAGATACCCTAGTAGTC |
| (SEQ ID NO: 517) | CCTACGGGAGGCATCAGGCAGATCTCGTGCAGCAAGATTACATACTGAGCAAGTCAGTCAGCCGGATTAGATACCCTAGTAGTC |
| (SEQ ID NO: 518) | CCTACGGGAGGCATCAGGCAGATCTCGAGCAACATTGCAGGCTAAACTATGAGTCAGTCAGCCGGATTAGATACCCTAGTAGTC |
| (SEQ ID NO: 519) | CCTACGGGAGGCATCAGGCAGATCTCGGATGTGGTGTTAAAGAGCAGAGCCAGTCAGTCAGCCGGATTAGATACCCTAGTAGTC |
| (SEQ ID NO: 520) | CCTACGGGAGGCATCAGGCAGATCTCGCAGAAATGTGTCGGAGAGATCACGAGTCAGTCAGCCGGATTAGATACCCTAGTAGTC |
| (SEQ ID NO: 521) | CCTACGGGAGGCATCAGGCAGATCTCGGTAGAGGTAGAGTCAACCCGTGAAAGTCAGTCAGCCGGATTAGATACCCTAGTAGTC |
| (SEQ ID NO: 522) | CCTACGGGAGGCATCAGGCAGATCTCGCGTGATCCGCTAGTTTGAAACACGAGTCAGTCAGCCGGATTAGATACCCTAGTAGTC |
| (SEQ ID NO: 523) | CCTACGGGAGGCATCAGGCAGATCTCGGGTTATTTGGCGAGAGAGACAGGTAGTCAGTCAGCCGGATTAGATACCCTAGTAGTC |
| (SEQ ID NO: 524) | CCTACGGGAGGCATCAGGCAGATCTCGGGATCGTAATACTCGCCAGTGCATAGTCAGTCAGCCGGATTAGATACCCTAGTAGTC |
| (SEQ ID NO: 525) | CCTACGGGAGGCATCAGGCAGATCTCGGCATAGCATCAAGCTCAGGACTCTAGTCAGTCAGCCGGATTAGATACCCTAGTAGTC |
| (SEQ ID NO: 526) | CCTACGGGAGGCATCAGGCAGATCTCGGTGTTAGATGTGCACTTTGGGTGCAGTCAGTCAGCCGGATTAGATACCCTAGTAGTC |
| (SEQ ID NO: 527) | CCTACGGGAGGCATCAGGCAGATCTCGTTAGAGCCATGCTCTAGCCTGGCAAGTCAGTCAGCCGGATTAGATACCCTAGTAGTC |
| (SEQ ID NO: 528) | CCTACGGGAGGCATCAGGCAGATCTCGTGAACCCTATGGAATGCAATGCGTAGTCAGTCAGCCGGATTAGATACCCTAGTAGTC |
| (SEQ ID NO: 529) | CCTACGGGAGGCATCAGGCAGATCTCGAGAGTCTTGCCACGAATGAGTCATAGTCAGTCAGCCGGATTAGATACCCTAGTAGTC |
| (SEQ ID NO: 530) | CCTACGGGAGGCATCAGGCAGATCTCGACAACACTCCGACAACGCTAGAATAGTCAGTCAGCCGGATTAGATACCCTAGTAGTC |
| (SEQ ID NO: 531) | CCTACGGGAGGCATCAGGCAGATCTCGCGATGCTGTTGAATCAGAGCCCATAGTCAGTCAGCCGGATTAGATACCCTAGTAGTC |
| (SEQ ID NO: 532) | CCTACGGGAGGCATCAGGCAGATCTCGACGACTGCATAATCTGTAGAGCCAAGTCAGTCAGCCGGATTAGATACCCTAGTAGTC |
| (SEQ ID NO: 533) | CCTACGGGAGGCATCAGGCAGATCTCGACGCGAACTAATCCGACTCTAGGTAGTCAGTCAGCCGGATTAGATACCCTAGTAGTC |
| (SEQ ID NO: 534) | CCTACGGGAGGCATCAGGCAGATCTCGAGCTATGTATGGATCCTACGAGCAAGTCAGTCAGCCGGATTAGATACCCTAGTAGTC |
| (SEQ ID NO: 535) | CCTACGGGAGGCATCAGGCAGATCTCGACGGGTCATCATGACAACGAATCTAGTCAGTCAGCCGGATTAGATACCCTAGTAGTC |
| (SEQ ID NO: 536) | CCTACGGGAGGCATCAGGCAGATCTCGGAAACATCCCACTGCGGTTGACTCAGTCAGTCAGCCGGATTAGATACCCTAGTAGTC |
| (SEQ ID NO: 537) | CCTACGGGAGGCATCAGGCAGATCTCGCGTACTCTCGAGTGAGAAGAAAGGAGTCAGTCAGCCGGATTAGATACCCTAGTAGTC |
| (SEQ ID NO: 538) | CCTACGGGAGGCATCAGGCAGATCTCGTCAGTTCTCGTTTCGGATCTGTGAAGTCAGTCAGCCGGATTAGATACCCTAGTAGTC |
| (SEQ ID NO: 539) | CCTACGGGAGGCATCAGGCAGATCTCGTCGTGCGTGTTGGCCGGTACTCTAAGTCAGTCAGCCGGATTAGATACCCTAGTAGTC |
| (SEQ ID NO: 540) | CCTACGGGAGGCATCAGGCAGATCTCGGTTATCGCATGGCACAGGATTACCAGTCAGTCAGCCGGATTAGATACCCTAGTAGTC |

TABLE 3-continued

| | full sequence |
|---|---|
| (SEQ ID NO: 541) | CCTACGGGAGGCATCAGGCAGATCTCGGATCACGAGAGGCGATATCAGTAGAGTCAGTCAGCCGGATTAGATACCCTAGTAGTC |
| (SEQ ID NO: 542) | CCTACGGGAGGCATCAGGCAGATCTCGGTAAATTCAGGCCATAAGGGAGGCAGTCAGTCAGCCGGATTAGATACCCTAGTAGTC |
| (SEQ ID NO: 543) | CCTACGGGAGGCATCAGGCAGATCTCGAGTGTTTCGGACTGTGTTACTCCTAGTCAGTCAGCCGGATTAGATACCCTAGTAGTC |
| (SEQ ID NO: 544) | CCTACGGGAGGCATCAGGCAGATCTCGACACGCGGTTTAGGTACCTGCAATAGTCAGTCAGCCGGATTAGATACCCTAGTAGTC |
| (SEQ ID NO: 545) | CCTACGGGAGGCATCAGGCAGATCTCGTGGCAAATCTAGTCGCCTATAAGGAGTCAGTCAGCCGGATTAGATACCCTAGTAGTC |
| (SEQ ID NO: 546) | CCTACGGGAGGCATCAGGCAGATCTCGCACCTTACCTTAAGTGGCACTATCAGTCAGTCAGCCGGATTAGATACCCTAGTAGTC |
| (SEQ ID NO: 547) | CCTACGGGAGGCATCAGGCAGATCTCGTTAACCTTCCTGTAACCCGATAGAAGTCAGTCAGCCGGATTAGATACCCTAGTAGTC |
| (SEQ ID NO: 548) | CCTACGGGAGGCATCAGGCAGATCTCGTGCCGTATGCCAGTGTGCTAACGTAGTCAGTCAGCCGGATTAGATACCCTAGTAGTC |
| (SEQ ID NO: 549) | CCTACGGGAGGCATCAGGCAGATCTCGCGTGACAATAGTCTTGCGGCAATCAGTCAGTCAGCCGGATTAGATACCCTAGTAGTC |
| (SEQ ID NO: 550) | CCTACGGGAGGCATCAGGCAGATCTCGCGCTACAACTCGTGAGGTTTGATGAGTCAGTCAGCCGGATTAGATACCCTAGTAGTC |
| (SEQ ID NO: 551) | CCTACGGGAGGCATCAGGCAGATCTCGTTAAGACAGTCGATTGCTGGTCGAAGTCAGTCAGCCGGATTAGATACCCTAGTAGTC |
| (SEQ ID NO: 552) | CCTACGGGAGGCATCAGGCAGATCTCGTCTGCACTGAGCAAGAAGCCGGACAGTCAGTCAGCCGGATTAGATACCCTAGTAGTC |
| (SEQ ID NO: 553) | CCTACGGGAGGCATCAGGCAGATCTCGCGCAGATTAGTAACGGGATACAGGAGTCAGTCAGCCGGATTAGATACCCTAGTAGTC |
| (SEQ ID NO: 554) | CCTACGGGAGGCATCAGGCAGATCTCGTGGGTCCCACATAAGAGTCTCTAGAGTCAGTCAGCCGGATTAGATACCCTAGTAGTC |
| (SEQ ID NO: 555) | CCTACGGGAGGCATCAGGCAGATCTCGCACTGGTGCATATCCGTCATGGGTAGTCAGTCAGCCGGATTAGATACCCTAGTAGTC |
| (SEQ ID NO: 556) | CCTACGGGAGGCATCAGGCAGATCTCGAACGTAGGCTCTAGATCTATGCAGAGTCAGTCAGCCGGATTAGATACCCTAGTAGTC |
| (SEQ ID NO: 557) | CCTACGGGAGGCATCAGGCAGATCTCGAGTTGTAGTCCGGCACAAGGCAAGAGTCAGTCAGCCGGATTAGATACCCTAGTAGTC |
| (SEQ ID NO: 558) | CCTACGGGAGGCATCAGGCAGATCTCGTCGTCAAACCCGCGGCAAACACTTAGTCAGTCAGCCGGATTAGATACCCTAGTAGTC |
| (SEQ ID NO: 559) | CCTACGGGAGGCATCAGGCAGATCTCGTAATCGGTGCCAGCGAGTTCCTGTAGTCAGTCAGCCGGATTAGATACCCTAGTAGTC |
| (SEQ ID NO: 560) | CCTACGGGAGGCATCAGGCAGATCTCGTTGATCCGGTAGTTCCGAATCGGCAGTCAGTCAGCCGGATTAGATACCCTAGTAGTC |
| (SEQ ID NO: 561) | CCTACGGGAGGCATCAGGCAGATCTCGCGGGTGTTTGCTTACCTAGTGAGAAGTCAGTCAGCCGGATTAGATACCCTAGTAGTC |
| (SEQ ID NO: 562) | CCTACGGGAGGCATCAGGCAGATCTCGTTGACCGCGGTTCGTTCTGGTGGTAGTCAGTCAGCCGGATTAGATACCCTAGTAGTC |
| (SEQ ID NO: 563) | CCTACGGGAGGCATCAGGCAGATCTCGGTGCAACCAATCTTGGTCTCCTCTAGTCAGTCAGCCGGATTAGATACCCTAGTAGTC |
| (SEQ ID NO: 564) | CCTACGGGAGGCATCAGGCAGATCTCGGCTTGAGCTTGACTGCATACTGAGAGTCAGTCAGCCGGATTAGATACCCTAGTAGTC |
| (SEQ ID NO: 565) | CCTACGGGAGGCATCAGGCAGATCTCGCGCTGTGGATTACAGGGCCTTTGTAGTCAGTCAGCCGGATTAGATACCCTAGTAGTC |
| (SEQ ID NO: 566) | CCTACGGGAGGCATCAGGCAGATCTCGCTGTCAGTGACCCGATGAATATCGAGTCAGTCAGCCGGATTAGATACCCTAGTAGTC |
| (SEQ ID NO: 567) | CCTACGGGAGGCATCAGGCAGATCTCGACGATTCGAGTCGTCAATTAGTGGAGTCAGTCAGCCGGATTAGATACCCTAGTAGTC |
| (SEQ ID NO: 568) | CCTACGGGAGGCATCAGGCAGATCTCGGGTTCGGTCCATAGTACGCAGTCTAGTCAGTCAGCCGGATTAGATACCCTAGTAGTC |
| (SEQ ID NO: 569) | CCTACGGGAGGCATCAGGCAGATCTCGCTGATCCATCTTAGCAGCTATTGCAGTCAGTCAGCCGGATTAGATACCCTAGTAGTC |
| (SEQ ID NO: 570) | CCTACGGGAGGCATCAGGCAGATCTCGTATGTGCCGGCTCTCGGATAGATCAGTCAGTCAGCCGGATTAGATACCCTAGTAGTC |
| (SEQ ID NO: 571) | CCTACGGGAGGCATCAGGCAGATCTCGTGGTCGCATCGTTTCCCGAAACGAAGTCAGTCAGCCGGATTAGATACCCTAGTAGTC |
| (SEQ ID NO: 572) | CCTACGGGAGGCATCAGGCAGATCTCGTGTAAGACTTGGGAACTTTAGCGCAGTCAGTCAGCCGGATTAGATACCCTAGTAGTC |
| (SEQ ID NO: 573) | CCTACGGGAGGCATCAGGCAGATCTCGCGGATCTAGTGTTCCTTAGAAGGCAGTCAGTCAGCCGGATTAGATACCCTAGTAGTC |
| (SEQ ID NO: 574) | CCTACGGGAGGCATCAGGCAGATCTCGCGATCTTCGAGCGATGGACTTCAAAGTCAGTCAGCCGGATTAGATACCCTAGTAGTC |
| (SEQ ID NO: 575) | CCTACGGGAGGCATCAGGCAGATCTCGGTCGAATTTGCGTACTGAGCCTCGAGTCAGTCAGCCGGATTAGATACCCTAGTAGTC |
| (SEQ ID NO: 576) | CCTACGGGAGGCATCAGGCAGATCTCGGCATCAGAGTTAAGAAGGCCTTATAGTCAGTCAGCCGGATTAGATACCCTAGTAGTC |
| (SEQ ID NO: 577) | CCTACGGGAGGCATCAGGCAGATCTCGGTGGTCATCGTATGGAGCCTTGTCAGTCAGTCAGCCGGATTAGATACCCTAGTAGTC |
| (SEQ ID NO: 578) | CCTACGGGAGGCATCAGGCAGATCTCGCTGAAGGGCGAACTCGATGTAAGCAGTCAGTCAGCCGGATTAGATACCCTAGTAGTC |
| (SEQ ID NO: 579) | CCTACGGGAGGCATCAGGCAGATCTCGCGCTCACAGAATAGCTTCGACAGTAGTCAGTCAGCCGGATTAGATACCCTAGTAGTC |

TABLE 3-continued

| | full sequence |
|---|---|
| (SEQ ID NO: 580) | CCTACGGGAGGCATCAGGCAGATCTCGATTCGGTAGTGCATACGCATCAAGAGTCAGTCAGCCGGATTAGATACCCTAGTAGTC |
| (SEQ ID NO: 581) | CCTACGGGAGGCATCAGGCAGATCTCGCGAGCTGTTACCAGATGTCCGTCAAGTCAGTCAGCCGGATTAGATACCCTAGTAGTC |
| (SEQ ID NO: 582) | CCTACGGGAGGCATCAGGCAGATCTCGCAACACATGCTGGCACCTGTTGAAAGTCAGTCAGCCGGATTAGATACCCTAGTAGTC |
| (SEQ ID NO: 583) | CCTACGGGAGGCATCAGGCAGATCTCGATTCTCTCACGTCCTAGAGAAACTAGTCAGTCAGCCGGATTAGATACCCTAGTAGTC |
| (SEQ ID NO: 584) | CCTACGGGAGGCATCAGGCAGATCTCGCGACTCTAAACGGAGGTTCTTGACAGTCAGTCAGCCGGATTAGATACCCTAGTAGTC |
| (SEQ ID NO: 585) | CCTACGGGAGGCATCAGGCAGATCTCGGTCTTCAGCAAGCTGTAAAGGTTGAGTCAGTCAGCCGGATTAGATACCCTAGTAGTC |
| (SEQ ID NO: 586) | CCTACGGGAGGCATCAGGCAGATCTCGCGGATAACCTCCTGAGTCATTGAGAGTCAGTCAGCCGGATTAGATACCCTAGTAGTC |
| (SEQ ID NO: 587) | CCTACGGGAGGCATCAGGCAGATCTCGAGGGTGACTTTATACGGCAGTTCAAGTCAGTCAGCCGGATTAGATACCCTAGTAGTC |
| (SEQ ID NO: 588) | CCTACGGGAGGCATCAGGCAGATCTCGGACTTCATGCGACTCTAGAAGAGTAGTCAGTCAGCCGGATTAGATACCCTAGTAGTC |
| (SEQ ID NO: 589) | CCTACGGGAGGCATCAGGCAGATCTCGGCCTGTCTGCAATGCACAGTCGCTAGTCAGTCAGCCGGATTAGATACCCTAGTAGTC |
| (SEQ ID NO: 590) | CCTACGGGAGGCATCAGGCAGATCTCGACTGATGGCCTCCATGCGGATCCTAGTCAGTCAGCCGGATTAGATACCCTAGTAGTC |
| (SEQ ID NO: 591) | CCTACGGGAGGCATCAGGCAGATCTCGTTCGATGCCGCATGCTCCGTAGAAAGTCAGTCAGCCGGATTAGATACCCTAGTAGTC |
| (SEQ ID NO: 592) | CCTACGGGAGGCATCAGGCAGATCTCGTGTGGCTCGTGTTGATAGGTACACAGTCAGTCAGCCGGATTAGATACCCTAGTAGTC |
| (SEQ ID NO: 593) | CCTACGGGAGGCATCAGGCAGATCTCGAACTTTCAGGAGCGAGTTCATCGAAGTCAGTCAGCCGGATTAGATACCCTAGTAGTC |
| (SEQ ID NO: 594) | CCTACGGGAGGCATCAGGCAGATCTCGTGCACGTGATAAAAGCAGATTGTCAGTCAGTCAGCCGGATTAGATACCCTAGTAGTC |
| (SEQ ID NO: 595) | CCTACGGGAGGCATCAGGCAGATCTCGGTTCGGTGTCCATAGAGGCGTAGGAGTCAGTCAGCCGGATTAGATACCCTAGTAGTC |
| (SEQ ID NO: 596) | CCTACGGGAGGCATCAGGCAGATCTCGAAGACAGCTATCTCAGCGCCGTTAAGTCAGTCAGCCGGATTAGATACCCTAGTAGTC |
| (SEQ ID NO: 597) | CCTACGGGAGGCATCAGGCAGATCTCGATTGACCGGTCATAGACCGACTCCAGTCAGTCAGCCGGATTAGATACCCTAGTAGTC |
| (SEQ ID NO: 598) | CCTACGGGAGGCATCAGGCAGATCTCGTTCTCCATCACAGTCAACGCTGTCAGTCAGTCAGCCGGATTAGATACCCTAGTAGTC |
| (SEQ ID NO: 599) | CCTACGGGAGGCATCAGGCAGATCTCGCGTAGGTAGAGGACAGGAGGGTGTAGTCAGTCAGCCGGATTAGATACCCTAGTAGTC |
| (SEQ ID NO: 600) | CCTACGGGAGGCATCAGGCAGATCTCGATTTAGGACGACGCTGTCGTCAACAGTCAGTCAGCCGGATTAGATACCCTAGTAGTC |
| (SEQ ID NO: 601) | CCTACGGGAGGCATCAGGCAGATCTCGGGATAGCCAAGGATAGAGGCCATTAGTCAGTCAGCCGGATTAGATACCCTAGTAGTC |
| (SEQ ID NO: 602) | CCTACGGGAGGCATCAGGCAGATCTCGTGGTTGGTTACGAAGCTTGAAACCAGTCAGTCAGCCGGATTAGATACCCTAGTAGTC |
| (SEQ ID NO: 603) | CCTACGGGAGGCATCAGGCAGATCTCGGTCGTCCAAATGTAAGCGTCTCGAAGTCAGTCAGCCGGATTAGATACCCTAGTAGTC |
| (SEQ ID NO: 604) | CCTACGGGAGGCATCAGGCAGATCTCGCAACGTGCTCCAATAGCTTCGTGGAGTCAGTCAGCCGGATTAGATACCCTAGTAGTC |
| (SEQ ID NO: 605) | CCTACGGGAGGCATCAGGCAGATCTCGTACACAAGTCGCCGGGATCAAATTAGTCAGTCAGCCGGATTAGATACCCTAGTAGTC |
| (SEQ ID NO: 606) | CCTACGGGAGGCATCAGGCAGATCTCGGCGTCCATGAATAGTCATCGAATGAGTCAGTCAGCCGGATTAGATACCCTAGTAGTC |
| (SEQ ID NO: 607) | CCTACGGGAGGCATCAGGCAGATCTCGGTAATGCGTAACATCTTGGAGTCGAGTCAGTCAGCCGGATTAGATACCCTAGTAGTC |
| (SEQ ID NO: 608) | CCTACGGGAGGCATCAGGCAGATCTCGGTCGCCGTACATAGCACCGGTCTTAGTCAGTCAGCCGGATTAGATACCCTAGTAGTC |
| (SEQ ID NO: 609) | CCTACGGGAGGCATCAGGCAGATCTCGGGAATCCGATTAGCAAATCAGCCTAGTCAGTCAGCCGGATTAGATACCCTAGTAGTC |
| (SEQ ID NO: 610) | CCTACGGGAGGCATCAGGCAGATCTCGCACCCGATGGTTGCAAGCTGTCTCAGTCAGTCAGCCGGATTAGATACCCTAGTAGTC |
| (SEQ ID NO: 611) | CCTACGGGAGGCATCAGGCAGATCTCGTTCTGAGAGGTAAGCGGCCTATTAAGTCAGTCAGCCGGATTAGATACCCTAGTAGTC |
| (SEQ ID NO: 612) | CCTACGGGAGGCATCAGGCAGATCTCGATCCCTACGGAATCTTCAACTACCAGTCAGTCAGCCGGATTAGATACCCTAGTAGTC |
| (SEQ ID NO: 613) | CCTACGGGAGGCATCAGGCAGATCTCGGGTTCCATTAGGTGGAATTCGGCTAGTCAGTCAGCCGGATTAGATACCCTAGTAGTC |
| (SEQ ID NO: 614) | CCTACGGGAGGCATCAGGCAGATCTCGGTGTTCCCAGAATAAGATGCAGTCAGTCAGTCAGCCGGATTAGATACCCTAGTAGTC |
| (SEQ ID NO: 615) | CCTACGGGAGGCATCAGGCAGATCTCGCCGAGGTATAATTGCCGAGTAATCAGTCAGTCAGCCGGATTAGATACCCTAGTAGTC |
| (SEQ ID NO: 616) | CCTACGGGAGGCATCAGGCAGATCTCGAGCGTAATTAGCACCTTGACAAGAAGTCAGTCAGCCGGATTAGATACCCTAGTAGTC |
| (SEQ ID NO: 617) | CCTACGGGAGGCATCAGGCAGATCTCGCTCGTGAATGACGTAACCACCACCAGTCAGTCAGCCGGATTAGATACCCTAGTAGTC |
| (SEQ ID NO: 618) | CCTACGGGAGGCATCAGGCAGATCTCGAGGTGAGTTCTACATAGCTCGGTCAGTCAGTCAGCCGGATTAGATACCCTAGTAGTC |

TABLE 3-continued

| | full sequence |
|---|---|
| (SEQ ID NO: 619) | CCTACGGGAGGCATCAGGCAGATCTCGCCTGTCCTATCTAACCATGCCAACAGTCAGTCAGCCGGATTAGATACCCTAGTAGTC |
| (SEQ ID NO: 620) | CCTACGGGAGGCATCAGGCAGATCTCGGGTTTAACACGCTATGGAGCTAGTAGTCAGTCAGCCGGATTAGATACCCTAGTAGTC |
| (SEQ ID NO: 621) | CCTACGGGAGGCATCAGGCAGATCTCGAGACAGTAGGAGACTACCTCTTCAAGTCAGTCAGCCGGATTAGATACCCTAGTAGTC |
| (SEQ ID NO: 622) | CCTACGGGAGGCATCAGGCAGATCTCGGCCACGACTTACGATGATAACCCAAGTCAGTCAGCCGGATTAGATACCCTAGTAGTC |
| (SEQ ID NO: 623) | CCTACGGGAGGCATCAGGCAGATCTCGATTGTTCCTACCGGCCCAATATAAAGTCAGTCAGCCGGATTAGATACCCTAGTAGTC |
| (SEQ ID NO: 624) | CCTACGGGAGGCATCAGGCAGATCTCGGCCGTAAACTTGTTGTATGACAGGAGTCAGTCAGCCGGATTAGATACCCTAGTAGTC |
| (SEQ ID NO: 625) | CCTACGGGAGGCATCAGGCAGATCTCGGCAGATTTCCAGGGTAAGTTTGACAGTCAGTCAGCCGGATTAGATACCCTAGTAGTC |
| (SEQ ID NO: 626) | CCTACGGGAGGCATCAGGCAGATCTCGAGATGATCAGTCCTACCACGGTACAGTCAGTCAGCCGGATTAGATACCCTAGTAGTC |
| (SEQ ID NO: 627) | CCTACGGGAGGCATCAGGCAGATCTCGGAGACGTGTTCTCGGTCTGTCTGAAGTCAGTCAGCCGGATTAGATACCCTAGTAGTC |
| (SEQ ID NO: 628) | CCTACGGGAGGCATCAGGCAGATCTCGTATCACCGGCACGTACATGTCGCCAGTCAGTCAGCCGGATTAGATACCCTAGTAGTC |
| (SEQ ID NO: 629) | CCTACGGGAGGCATCAGGCAGATCTCGTATGCCAGAGATTTCTAGAGTGCGAGTCAGTCAGCCGGATTAGATACCCTAGTAGTC |
| (SEQ ID NO: 630) | CCTACGGGAGGCATCAGGCAGATCTCGAGGTCCAAATCAACGGATGTTATGAGTCAGTCAGCCGGATTAGATACCCTAGTAGTC |
| (SEQ ID NO: 631) | CCTACGGGAGGCATCAGGCAGATCTCGACCGTGCTCACATTGAGGCTACAAAGTCAGTCAGCCGGATTAGATACCCTAGTAGTC |
| (SEQ ID NO: 632) | CCTACGGGAGGCATCAGGCAGATCTCGCTCCCTTTGTGTGTAGGAACCGGAAGTCAGTCAGCCGGATTAGATACCCTAGTAGTC |
| (SEQ ID NO: 633) | CCTACGGGAGGCATCAGGCAGATCTCGAGCTGCACCTAAACATCTAGCAGAAGTCAGTCAGCCGGATTAGATACCCTAGTAGTC |
| (SEQ ID NO: 634) | CCTACGGGAGGCATCAGGCAGATCTCGCCTTGACCGATGCCGACATTGTAGAGTCAGTCAGCCGGATTAGATACCCTAGTAGTC |
| (SEQ ID NO: 635) | CCTACGGGAGGCATCAGGCAGATCTCGCTATCATCCTCACATGTAAGGCTCAGTCAGTCAGCCGGATTAGATACCCTAGTAGTC |
| (SEQ ID NO: 636) | CCTACGGGAGGCATCAGGCAGATCTCGACTCTAGCCGGTTGCAAGCTAAGTAGTCAGTCAGCCGGATTAGATACCCTAGTAGTC |
| (SEQ ID NO: 637) | CCTACGGGAGGCATCAGGCAGATCTCGCGATAGGCCTTAGTGTGTGCCATAAGTCAGTCAGCCGGATTAGATACCCTAGTAGTC |
| (SEQ ID NO: 638) | CCTACGGGAGGCATCAGGCAGATCTCGAATGACCTCGTGTGACAACCGAATAGTCAGTCAGCCGGATTAGATACCCTAGTAGTC |
| (SEQ ID NO: 639) | CCTACGGGAGGCATCAGGCAGATCTCGCTTAGGCATGTGTAGGCTCGTGCTAGTCAGTCAGCCGGATTAGATACCCTAGTAGTC |
| (SEQ ID NO: 640) | CCTACGGGAGGCATCAGGCAGATCTCGCCAGATATAGCACTCCTTAAGGCGAGTCAGTCAGCCGGATTAGATACCCTAGTAGTC |
| (SEQ ID NO: 641) | CCTACGGGAGGCATCAGGCAGATCTCGGAGAGTCCACTTTTGCCTGGGTCAAGTCAGTCAGCCGGATTAGATACCCTAGTAGTC |
| (SEQ ID NO: 642) | CCTACGGGAGGCATCAGGCAGATCTCGGAACGGGACGTACAATTCTGCTTCAGTCAGTCAGCCGGATTAGATACCCTAGTAGTC |
| (SEQ ID NO: 643) | CCTACGGGAGGCATCAGGCAGATCTCGACGTGTAGGCTTACTGGCAAACCTAGTCAGTCAGCCGGATTAGATACCCTAGTAGTC |
| (SEQ ID NO: 644) | CCTACGGGAGGCATCAGGCAGATCTCGGGTCTCCTACAGAATCAGAGCTTGAGTCAGTCAGCCGGATTAGATACCCTAGTAGTC |
| (SEQ ID NO: 645) | CCTACGGGAGGCATCAGGCAGATCTCGACTGACTTAAGGCAATGTAGACACAGTCAGTCAGCCGGATTAGATACCCTAGTAGTC |
| (SEQ ID NO: 646) | CCTACGGGAGGCATCAGGCAGATCTCGGATGCTGCCGTTTGGCGATACGTTAGTCAGTCAGCCGGATTAGATACCCTAGTAGTC |
| (SEQ ID NO: 647) | CCTACGGGAGGCATCAGGCAGATCTCGTTCCTAGGCCAGGCCTTACGATAGAGTCAGTCAGCCGGATTAGATACCCTAGTAGTC |
| (SEQ ID NO: 648) | CCTACGGGAGGCATCAGGCAGATCTCGATTAAGCCTGGATACCTGTGTCTTAGTCAGTCAGCCGGATTAGATACCCTAGTAGTC |
| (SEQ ID NO: 649) | CCTACGGGAGGCATCAGGCAGATCTCGTGGCTTTCTATCAACGAGGCAACGAGTCAGTCAGCCGGATTAGATACCCTAGTAGTC |
| (SEQ ID NO: 650) | CCTACGGGAGGCATCAGGCAGATCTCGACAGCTCAAACAGAAGACAGCGACAGTCAGTCAGCCGGATTAGATACCCTAGTAGTC |
| (SEQ ID NO: 651) | CCTACGGGAGGCATCAGGCAGATCTCGGAGCGTATCCATACACCTGCGATCAGTCAGTCAGCCGGATTAGATACCCTAGTAGTC |
| (SEQ ID NO: 652) | CCTACGGGAGGCATCAGGCAGATCTCGATGGGCGAATGGGGCGTTGCATTCAGTCAGTCAGCCGGATTAGATACCCTAGTAGTC |
| (SEQ ID NO: 653) | CCTACGGGAGGCATCAGGCAGATCTCGGATCTCTGGGTAACTAGCGTTCAGAGTCAGTCAGCCGGATTAGATACCCTAGTAGTC |
| (SEQ ID NO: 654) | CCTACGGGAGGCATCAGGCAGATCTCGCATCATACGGGTTTGCGACAAAGTAGTCAGTCAGCCGGATTAGATACCCTAGTAGTC |
| (SEQ ID NO: 655) | CCTACGGGAGGCATCAGGCAGATCTCGTACGGATTATGGTGCGAGTATATGAGTCAGTCAGCCGGATTAGATACCCTAGTAGTC |
| (SEQ ID NO: 656) | CCTACGGGAGGCATCAGGCAGATCTCGATAGCGAACTCATACCACAACGAAAGTCAGTCAGCCGGATTAGATACCCTAGTAGTC |
| (SEQ ID NO: 657) | CCTACGGGAGGCATCAGGCAGATCTCGTAACGCTGTGTGTCTGGAACGGTTAGTCAGTCAGCCGGATTAGATACCCTAGTAGTC |

TABLE 3-continued

| | full sequence |
|---|---|
| (SEQ ID NO: 658) | CCTACGGGAGGCATCAGGCAGATCTCGAACCAAACTCGAGTACTACCTCGGAGTCAGTCAGCCGGATTAGATACCCTAGTAGTC |
| (SEQ ID NO: 659) | CCTACGGGAGGCATCAGGCAGATCTCGGCCGTCTCGTAATTCCTGTTAACCAGTCAGTCAGCCGGATTAGATACCCTAGTAGTC |
| (SEQ ID NO: 660) | CCTACGGGAGGCATCAGGCAGATCTCGCTGGGTATCTCGCTATCCAAGTGGAGTCAGTCAGCCGGATTAGATACCCTAGTAGTC |
| (SEQ ID NO: 661) | CCTACGGGAGGCATCAGGCAGATCTCGGACTACCCGTTGCAGTCTAGTACGAGTCAGTCAGCCGGATTAGATACCCTAGTAGTC |
| (SEQ ID NO: 662) | CCTACGGGAGGCATCAGGCAGATCTCGGCGTTGCAAACTGTGTCCGGATTCAGTCAGTCAGCCGGATTAGATACCCTAGTAGTC |
| (SEQ ID NO: 663) | CCTACGGGAGGCATCAGGCAGATCTCGAACCGCATAAGTTGTGGTGATGTAAGTCAGTCAGCCGGATTAGATACCCTAGTAGTC |
| (SEQ ID NO: 664) | CCTACGGGAGGCATCAGGCAGATCTCGACCTTACACCTTCTTTCGTTCAACAGTCAGTCAGCCGGATTAGATACCCTAGTAGTC |
| (SEQ ID NO: 665) | CCTACGGGAGGCATCAGGCAGATCTCGGTAGGTGCTTACCCGAAGATTCTGAGTCAGTCAGCCGGATTAGATACCCTAGTAGTC |
| (SEQ ID NO: 666) | CCTACGGGAGGCATCAGGCAGATCTCGCGCATTTGGATGGTTGGCGTTACAAGTCAGTCAGCCGGATTAGATACCCTAGTAGTC |
| (SEQ ID NO: 667) | CCTACGGGAGGCATCAGGCAGATCTCGATAACATGTGCGGAAGTAGCGAGCAGTCAGTCAGCCGGATTAGATACCCTAGTAGTC |
| (SEQ ID NO: 668) | CCTACGGGAGGCATCAGGCAGATCTCGCTTGAGAAATCGTTGCGGACCCTAAGTCAGTCAGCCGGATTAGATACCCTAGTAGTC |
| (SEQ ID NO: 669) | CCTACGGGAGGCATCAGGCAGATCTCGCTACACAGCACAGCGGAAACATGGAGTCAGTCAGCCGGATTAGATACCCTAGTAGTC |
| (SEQ ID NO: 670) | CCTACGGGAGGCATCAGGCAGATCTCGGAAATGCTACGTAACGTTAGTGTGAGTCAGTCAGCCGGATTAGATACCCTAGTAGTC |
| (SEQ ID NO: 671) | CCTACGGGAGGCATCAGGCAGATCTCGTCTGAGGTTGCCTGCATGACAGTCAGTCAGTCAGCCGGATTAGATACCCTAGTAGTC |
| (SEQ ID NO: 672) | CCTACGGGAGGCATCAGGCAGATCTCGGATCATTCTCTCTCAATCGCTTTCAGTCAGTCAGCCGGATTAGATACCCTAGTAGTC |
| (SEQ ID NO: 673) | CCTACGGGAGGCATCAGGCAGATCTCGAGACATACCGTACTACCGATTGCGAGTCAGTCAGCCGGATTAGATACCCTAGTAGTC |
| (SEQ ID NO: 674) | CCTACGGGAGGCATCAGGCAGATCTCGGATCCTCATGCGTCACCCAAGGTAAGTCAGTCAGCCGGATTAGATACCCTAGTAGTC |
| (SEQ ID NO: 675) | CCTACGGGAGGCATCAGGCAGATCTCGATTATCGTCCCTAGCCAGTCATACAGTCAGTCAGCCGGATTAGATACCCTAGTAGTC |
| (SEQ ID NO: 676) | CCTACGGGAGGCATCAGGCAGATCTCGCCAGACCGCTATTAACGGCGCTCTAGTCAGTCAGCCGGATTAGATACCCTAGTAGTC |
| (SEQ ID NO: 677) | CCTACGGGAGGCATCAGGCAGATCTCGAGCTCTAGAAACGTTTGCTCGAGAAGTCAGTCAGCCGGATTAGATACCCTAGTAGTC |
| (SEQ ID NO: 678) | CCTACGGGAGGCATCAGGCAGATCTCGTCCATCGACGTGCAAACGCACTAAAGTCAGTCAGCCGGATTAGATACCCTAGTAGTC |
| (SEQ ID NO: 679) | CCTACGGGAGGCATCAGGCAGATCTCGCGATGTGTGGTTGAACAAAGAGCGAGTCAGTCAGCCGGATTAGATACCCTAGTAGTC |
| (SEQ ID NO: 680) | CCTACGGGAGGCATCAGGCAGATCTCGGCGAAGTTGGGAGCTAAGTGATGTAGTCAGTCAGCCGGATTAGATACCCTAGTAGTC |
| (SEQ ID NO: 681) | CCTACGGGAGGCATCAGGCAGATCTCGGCATTCGGCGTTAAGGGACAAGTGAGTCAGTCAGCCGGATTAGATACCCTAGTAGTC |
| (SEQ ID NO: 682) | CCTACGGGAGGCATCAGGCAGATCTCGCGCCATTGTGCAAGTGTCGATTCGAGTCAGTCAGCCGGATTAGATACCCTAGTAGTC |
| (SEQ ID NO: 683) | CCTACGGGAGGCATCAGGCAGATCTCGTCCAACTGCAGACTATTAAGCGGCAGTCAGTCAGCCGGATTAGATACCCTAGTAGTC |
| (SEQ ID NO: 684) | CCTACGGGAGGCATCAGGCAGATCTCGTAAAGACCCGTACCTACCATTGTTAGTCAGTCAGCCGGATTAGATACCCTAGTAGTC |
| (SEQ ID NO: 685) | CCTACGGGAGGCATCAGGCAGATCTCGTGTATCTTCACCGAGTCCGTTGCTAGTCAGTCAGCCGGATTAGATACCCTAGTAGTC |
| (SEQ ID NO: 686) | CCTACGGGAGGCATCAGGCAGATCTCGGACTGACTCGTCGATAACTGTACGAGTCAGTCAGCCGGATTAGATACCCTAGTAGTC |
| (SEQ ID NO: 687) | CCTACGGGAGGCATCAGGCAGATCTCGTCGTGGATAGCTTAAACCTGGACAAGTCAGTCAGCCGGATTAGATACCCTAGTAGTC |
| (SEQ ID NO: 688) | CCTACGGGAGGCATCAGGCAGATCTCGGACGCACTAACTCCGAATTGACAAAGTCAGTCAGCCGGATTAGATACCCTAGTAGTC |
| (SEQ ID NO: 689) | CCTACGGGAGGCATCAGGCAGATCTCGGGCGATTTACGTCTGGCATCTAGCAGTCAGTCAGCCGGATTAGATACCCTAGTAGTC |
| (SEQ ID NO: 690) | CCTACGGGAGGCATCAGGCAGATCTCGTAAGGCATCGCTGGTGGTCGTTCTAGTCAGTCAGCCGGATTAGATACCCTAGTAGTC |
| (SEQ ID NO: 691) | CCTACGGGAGGCATCAGGCAGATCTCGACCCATACAGCCACTATGGGCTAAAGTCAGTCAGCCGGATTAGATACCCTAGTAGTC |
| (SEQ ID NO: 692) | CCTACGGGAGGCATCAGGCAGATCTCGCGCACTACGCATGCATTGAGTTCGAGTCAGTCAGCCGGATTAGATACCCTAGTAGTC |
| (SEQ ID NO: 693) | CCTACGGGAGGCATCAGGCAGATCTCGCAGTCGTTAAGAGTTGCTGAGTCCAGTCAGTCAGCCGGATTAGATACCCTAGTAGTC |
| (SEQ ID NO: 694) | CCTACGGGAGGCATCAGGCAGATCTCGCTACGAAAGCCTCTATGGTGAACCAGTCAGTCAGCCGGATTAGATACCCTAGTAGTC |
| (SEQ ID NO: 695) | CCTACGGGAGGCATCAGGCAGATCTCGATAATTGCCGAGGGACCAAGGGATAGTCAGTCAGCCGGATTAGATACCCTAGTAGTC |
| (SEQ ID NO: 696) | CCTACGGGAGGCATCAGGCAGATCTCGGGCATGTTATCGGTATTGGTCAGAAGTCAGTCAGCCGGATTAGATACCCTAGTAGTC |

TABLE 3-continued

| | full sequence |
|---|---|
| (SEQ ID NO: 697) | CCTACGGGAGGCATCAGGCAGATCTCGAGGCACAGTAGGAGAACCGTCATAAGTCAGTCAGCCGGATTAGATACCCTAGTAGTC |
| (SEQ ID NO: 698) | CCTACGGGAGGCATCAGGCAGATCTCGCTACTTACATCCAACTGGAACCCTAGTCAGTCAGCCGGATTAGATACCCTAGTAGTC |
| (SEQ ID NO: 699) | CCTACGGGAGGCATCAGGCAGATCTCGCTCTTCTGATCAATACTCGGCTGCAGTCAGTCAGCCGGATTAGATACCCTAGTAGTC |
| (SEQ ID NO: 700) | CCTACGGGAGGCATCAGGCAGATCTCGATGCTAACCACGACGCTTAACGACAGTCAGTCAGCCGGATTAGATACCCTAGTAGTC |
| (SEQ ID NO: 701) | CCTACGGGAGGCATCAGGCAGATCTCGACCAATCTCGGCAGCTTACCGACCAGTCAGTCAGCCGGATTAGATACCCTAGTAGTC |
| (SEQ ID NO: 702) | CCTACGGGAGGCATCAGGCAGATCTCGTATCCAAGCGCAAGGGCTATAGTTAGTCAGTCAGCCGGATTAGATACCCTAGTAGTC |
| (SEQ ID NO: 703) | CCTACGGGAGGCATCAGGCAGATCTCGGTACTGAAGATCTGTCTCGCAAGCAGTCAGTCAGCCGGATTAGATACCCTAGTAGTC |
| (SEQ ID NO: 704) | CCTACGGGAGGCATCAGGCAGATCTCGTCGCCGTGTACACAGCCGCATATCAGTCAGTCAGCCGGATTAGATACCCTAGTAGTC |
| (SEQ ID NO: 705) | CCTACGGGAGGCATCAGGCAGATCTCGAACTGCGATATGGATACGTTCGCAAGTCAGTCAGCCGGATTAGATACCCTAGTAGTC |
| (SEQ ID NO: 706) | CCTACGGGAGGCATCAGGCAGATCTCGCTTCCAACTCATCCAAGATTCGCCAGTCAGTCAGCCGGATTAGATACCCTAGTAGTC |
| (SEQ ID NO: 707) | CCTACGGGAGGCATCAGGCAGATCTCGGAGATCGCCTATGAGGCTGATTTAAGTCAGTCAGCCGGATTAGATACCCTAGTAGTC |
| (SEQ ID NO: 708) | CCTACGGGAGGCATCAGGCAGATCTCGTGTACATCGCCGGAGTTAGCATCAAGTCAGTCAGCCGGATTAGATACCCTAGTAGTC |
| (SEQ ID NO: 709) | CCTACGGGAGGCATCAGGCAGATCTCGTGTTAAGCAGCATGTAGTATAGGCAGTCAGTCAGCCGGATTAGATACCCTAGTAGTC |
| (SEQ ID NO: 710) | CCTACGGGAGGCATCAGGCAGATCTCGACGGCGTTATGTCTCACGCAATGCAGTCAGTCAGCCGGATTAGATACCCTAGTAGTC |
| (SEQ ID NO: 711) | CCTACGGGAGGCATCAGGCAGATCTCGACTTTGCTTTGCGTCCCGTGAAATAGTCAGTCAGCCGGATTAGATACCCTAGTAGTC |
| (SEQ ID NO: 712) | CCTACGGGAGGCATCAGGCAGATCTCGCAAAGCGGTATTGGACAGTGTATTAGTCAGTCAGCCGGATTAGATACCCTAGTAGTC |
| (SEQ ID NO: 713) | CCTACGGGAGGCATCAGGCAGATCTCGCGAAACTACGTAACACGACTATAGAGTCAGTCAGCCGGATTAGATACCCTAGTAGTC |
| (SEQ ID NO: 714) | CCTACGGGAGGCATCAGGCAGATCTCGGAGGACCAGCAAGTGTAGGTGCTTAGTCAGTCAGCCGGATTAGATACCCTAGTAGTC |
| (SEQ ID NO: 715) | CCTACGGGAGGCATCAGGCAGATCTCGAATAGCATGTCGTGAACTAGCGTCAGTCAGTCAGCCGGATTAGATACCCTAGTAGTC |
| (SEQ ID NO: 716) | CCTACGGGAGGCATCAGGCAGATCTCGCGGAGTAATCCTTCCGAGTCACCAAGTCAGTCAGCCGGATTAGATACCCTAGTAGTC |
| (SEQ ID NO: 717) | CCTACGGGAGGCATCAGGCAGATCTCGCTGTGTCCATGGTCCTCTTTGGTCAGTCAGTCAGCCGGATTAGATACCCTAGTAGTC |
| (SEQ ID NO: 718) | CCTACGGGAGGCATCAGGCAGATCTCGCTTCGCGGATGTTCCACCCTCTATAGTCAGTCAGCCGGATTAGATACCCTAGTAGTC |
| (SEQ ID NO: 719) | CCTACGGGAGGCATCAGGCAGATCTCGATAGGCTGTAGTTCGTGACGCTAAAGTCAGTCAGCCGGATTAGATACCCTAGTAGTC |
| (SEQ ID NO: 720) | CCTACGGGAGGCATCAGGCAGATCTCGTGTGTAGCCATGACGGCTAGTTCCAGTCAGTCAGCCGGATTAGATACCCTAGTAGTC |
| (SEQ ID NO: 721) | CCTACGGGAGGCATCAGGCAGATCTCGAAGGGCGCTGAAGCACTGGCATATAGTCAGTCAGCCGGATTAGATACCCTAGTAGTC |
| (SEQ ID NO: 722) | CCTACGGGAGGCATCAGGCAGATCTCGGTTTCCGTGGTGGGCATTAGTTGAAGTCAGTCAGCCGGATTAGATACCCTAGTAGTC |
| (SEQ ID NO: 723) | CCTACGGGAGGCATCAGGCAGATCTCGAGGAACCAGACGCGGTAGTTGATCAGTCAGTCAGCCGGATTAGATACCCTAGTAGTC |
| (SEQ ID NO: 724) | CCTACGGGAGGCATCAGGCAGATCTCGTAATGCCCAGGTTGAAAGCGGCGAAGTCAGTCAGCCGGATTAGATACCCTAGTAGTC |
| (SEQ ID NO: 725) | CCTACGGGAGGCATCAGGCAGATCTCGTATGAACGTCCGGGTTACGGTTACAGTCAGTCAGCCGGATTAGATACCCTAGTAGTC |
| (SEQ ID NO: 726) | CCTACGGGAGGCATCAGGCAGATCTCGCCACATTGGGTCACATCAGGTCACAGTCAGTCAGCCGGATTAGATACCCTAGTAGTC |
| (SEQ ID NO: 727) | CCTACGGGAGGCATCAGGCAGATCTCGTCAGTCAGATGAGTTGATACGATGAGTCAGTCAGCCGGATTAGATACCCTAGTAGTC |
| (SEQ ID NO: 728) | CCTACGGGAGGCATCAGGCAGATCTCGAAGTCACACACACAGACACTTCCGAGTCAGTCAGCCGGATTAGATACCCTAGTAGTC |
| (SEQ ID NO: 729) | CCTACGGGAGGCATCAGGCAGATCTCGGCTGTGATTCGATCACCATCCGAGAGTCAGTCAGCCGGATTAGATACCCTAGTAGTC |
| (SEQ ID NO: 730) | CCTACGGGAGGCATCAGGCAGATCTCGCTAGCTATGGACACCCACCACTAGAGTCAGTCAGCCGGATTAGATACCCTAGTAGTC |
| (SEQ ID NO: 731) | CCTACGGGAGGCATCAGGCAGATCTCGCTTGACGAGGTTCAGAAGGTGTGGAGTCAGTCAGCCGGATTAGATACCCTAGTAGTC |
| (SEQ ID NO: 732) | CCTACGGGAGGCATCAGGCAGATCTCGACCTGGGAATATGAAGCTTGAATCAGTCAGTCAGCCGGATTAGATACCCTAGTAGTC |
| (SEQ ID NO: 733) | CCTACGGGAGGCATCAGGCAGATCTCGCTCTGCCTAATTACTAGGATCAGTAGTCAGTCAGCCGGATTAGATACCCTAGTAGTC |
| (SEQ ID NO: 734) | CCTACGGGAGGCATCAGGCAGATCTCGATATGACCCAGCGCTCCTTAGAAGAGTCAGTCAGCCGGATTAGATACCCTAGTAGTC |
| (SEQ ID NO: 735) | CCTACGGGAGGCATCAGGCAGATCTCGCTCTATTCCACCTCCCATTCCCATAGTCAGTCAGCCGGATTAGATACCCTAGTAGTC |

TABLE 3-continued

| | full sequence |
|---|---|
| (SEQ ID NO: 736) | CCTACGGGAGGCATCAGGCAGATCTCGATTGAGTGAGTCTGGCGTCATTCGAGTCAGTCAGCCGGATTAGATACCCTAGTAGTC |
| (SEQ ID NO: 737) | CCTACGGGAGGCATCAGGCAGATCTCGTTATGGTACGGAAATCCTCGGAGTAGTCAGTCAGCCGGATTAGATACCCTAGTAGTC |
| (SEQ ID NO: 738) | CCTACGGGAGGCATCAGGCAGATCTCGGCTAGTTATGGACTGGACGCATTAAGTCAGTCAGCCGGATTAGATACCCTAGTAGTC |
| (SEQ ID NO: 739) | CCTACGGGAGGCATCAGGCAGATCTCGCAGATTAACCAGACCGATTAGGTAAGTCAGTCAGCCGGATTAGATACCCTAGTAGTC |
| (SEQ ID NO: 740) | CCTACGGGAGGCATCAGGCAGATCTCGGGCTGCATACTCATGTGCTGCTCGAGTCAGTCAGCCGGATTAGATACCCTAGTAGTC |
| (SEQ ID NO: 741) | CCTACGGGAGGCATCAGGCAGATCTCGTTGGTAAAGTGCTACGTACGAAACAGTCAGTCAGCCGGATTAGATACCCTAGTAGTC |
| (SEQ ID NO: 742) | CCTACGGGAGGCATCAGGCAGATCTCGAAGTGGCTATCCATCACATTCTCCAGTCAGTCAGCCGGATTAGATACCCTAGTAGTC |
| (SEQ ID NO: 743) | CCTACGGGAGGCATCAGGCAGATCTCGAACCGATGTACCAGCCTGGTACCTAGTCAGTCAGCCGGATTAGATACCCTAGTAGTC |
| (SEQ ID NO: 744) | CCTACGGGAGGCATCAGGCAGATCTCGTCGATTGGCCGTGCTAAAGTCGTAAGTCAGTCAGCCGGATTAGATACCCTAGTAGTC |
| (SEQ ID NO: 745) | CCTACGGGAGGCATCAGGCAGATCTCGGCATTACTGGACTCTCAGCGCGTAAGTCAGTCAGCCGGATTAGATACCCTAGTAGTC |
| (SEQ ID NO: 746) | CCTACGGGAGGCATCAGGCAGATCTCGTTGGGCCACATAGACCCTAGACCTAGTCAGTCAGCCGGATTAGATACCCTAGTAGTC |
| (SEQ ID NO: 747) | CCTACGGGAGGCATCAGGCAGATCTCGCACACAAAGTCATATTCAGCGGACAGTCAGTCAGCCGGATTAGATACCCTAGTAGTC |
| (SEQ ID NO: 748) | CCTACGGGAGGCATCAGGCAGATCTCGGCCAAGGATAGGGTTCCGGATTAGAGTCAGTCAGCCGGATTAGATACCCTAGTAGTC |
| (SEQ ID NO: 749) | CCTACGGGAGGCATCAGGCAGATCTCGCGCCACGTGTATGCGTGTAATTAGAGTCAGTCAGCCGGATTAGATACCCTAGTAGTC |
| (SEQ ID NO: 750) | CCTACGGGAGGCATCAGGCAGATCTCGGCAACCGATTGTCTGTAGCTTGGCAGTCAGTCAGCCGGATTAGATACCCTAGTAGTC |
| (SEQ ID NO: 751) | CCTACGGGAGGCATCAGGCAGATCTCGCATGTGCTTAGGATGCCTCGTAAGAGTCAGTCAGCCGGATTAGATACCCTAGTAGTC |
| (SEQ ID NO: 752) | CCTACGGGAGGCATCAGGCAGATCTCGGTTCCTCCATTAACCTATGGTGAAAGTCAGTCAGCCGGATTAGATACCCTAGTAGTC |
| (SEQ ID NO: 753) | CCTACGGGAGGCATCAGGCAGATCTCGACCTGTCCTTTCCTGTTACAGCGAAGTCAGTCAGCCGGATTAGATACCCTAGTAGTC |
| (SEQ ID NO: 754) | CCTACGGGAGGCATCAGGCAGATCTCGGTTCACGCCCAACAGTCAGGCCTTAGTCAGTCAGCCGGATTAGATACCCTAGTAGTC |
| (SEQ ID NO: 755) | CCTACGGGAGGCATCAGGCAGATCTCGCGATCGAACACTACTGAGCTGCATAGTCAGTCAGCCGGATTAGATACCCTAGTAGTC |
| (SEQ ID NO: 756) | CCTACGGGAGGCATCAGGCAGATCTCGCATGCCAACATGACGAAGTCTACCAGTCAGTCAGCCGGATTAGATACCCTAGTAGTC |
| (SEQ ID NO: 757) | CCTACGGGAGGCATCAGGCAGATCTCGGAGTACAGTCTAACCGTCTTTCTCAGTCAGTCAGCCGGATTAGATACCCTAGTAGTC |
| (SEQ ID NO: 758) | CCTACGGGAGGCATCAGGCAGATCTCGCCTACATGAGACAGTCTGTCTGCGAGTCAGTCAGCCGGATTAGATACCCTAGTAGTC |
| (SEQ ID NO: 759) | CCTACGGGAGGCATCAGGCAGATCTCGTCCGTGGTATAGCCGCACTCAAGTAGTCAGTCAGCCGGATTAGATACCCTAGTAGTC |
| (SEQ ID NO: 760) | CCTACGGGAGGCATCAGGCAGATCTCGTCTACGGCACGTTGTGGAAACTCCAGTCAGTCAGCCGGATTAGATACCCTAGTAGTC |
| (SEQ ID NO: 761) | CCTACGGGAGGCATCAGGCAGATCTCGATGCTGCAACACTTAGGCAGGTTCAGTCAGTCAGCCGGATTAGATACCCTAGTAGTC |
| (SEQ ID NO: 762) | CCTACGGGAGGCATCAGGCAGATCTCGTTCTCATGGAGGTAAGACTACTGGAGTCAGTCAGCCGGATTAGATACCCTAGTAGTC |
| (SEQ ID NO: 763) | CCTACGGGAGGCATCAGGCAGATCTCGCATAGTGATTGGCGCGAAGTTTCAAGTCAGTCAGCCGGATTAGATACCCTAGTAGTC |
| (SEQ ID NO: 764) | CCTACGGGAGGCATCAGGCAGATCTCGGCTATCAAGACACGATACACTGCCAGTCAGTCAGCCGGATTAGATACCCTAGTAGTC |
| (SEQ ID NO: 765) | CCTACGGGAGGCATCAGGCAGATCTCGCCGTGACAACTCTTGAAATCCCGGAGTCAGTCAGCCGGATTAGATACCCTAGTAGTC |
| (SEQ ID NO: 766) | CCTACGGGAGGCATCAGGCAGATCTCGCGTTCCTTGTTAGTTAGGGAGCGAAGTCAGTCAGCCGGATTAGATACCCTAGTAGTC |
| (SEQ ID NO: 767) | CCTACGGGAGGCATCAGGCAGATCTCGGGAATTATCGGTTTACTGTGGCCGAGTCAGTCAGCCGGATTAGATACCCTAGTAGTC |
| (SEQ ID NO: 768) | CCTACGGGAGGCATCAGGCAGATCTCGCATCAAGCATAGATATAAGGCCCAAGTCAGTCAGCCGGATTAGATACCCTAGTAGTC |

In another embodiment, spike-in control compositions are provided for use in a method that simultaneously 1) controls for cross-contamination and/or sample swapping and 2) allows for quantitation while controlling for different GC content samples (e.g., low, balanced, and high GC content). In this embodiment, nucleic acid constructs are used with barcode sequence fragments, and with GC content fragments where the barcode sequence fragments and the GC content fragments are positioned between universal sequence fragments (see FIG. 11). In one embodiment, the barcode sequence fragment is linked at its 3' end to the 5' end of the GC content fragment, and the barcode sequence fragment is linked at its 5' end to a universal sequence fragment while the GC content fragment is linked at its 3' end to a universal sequence fragment. In this embodiment, the GC content fragment can be used to control for polymerase, transposase, ligase, or repair enzyme GC content bias.

Figure 11:
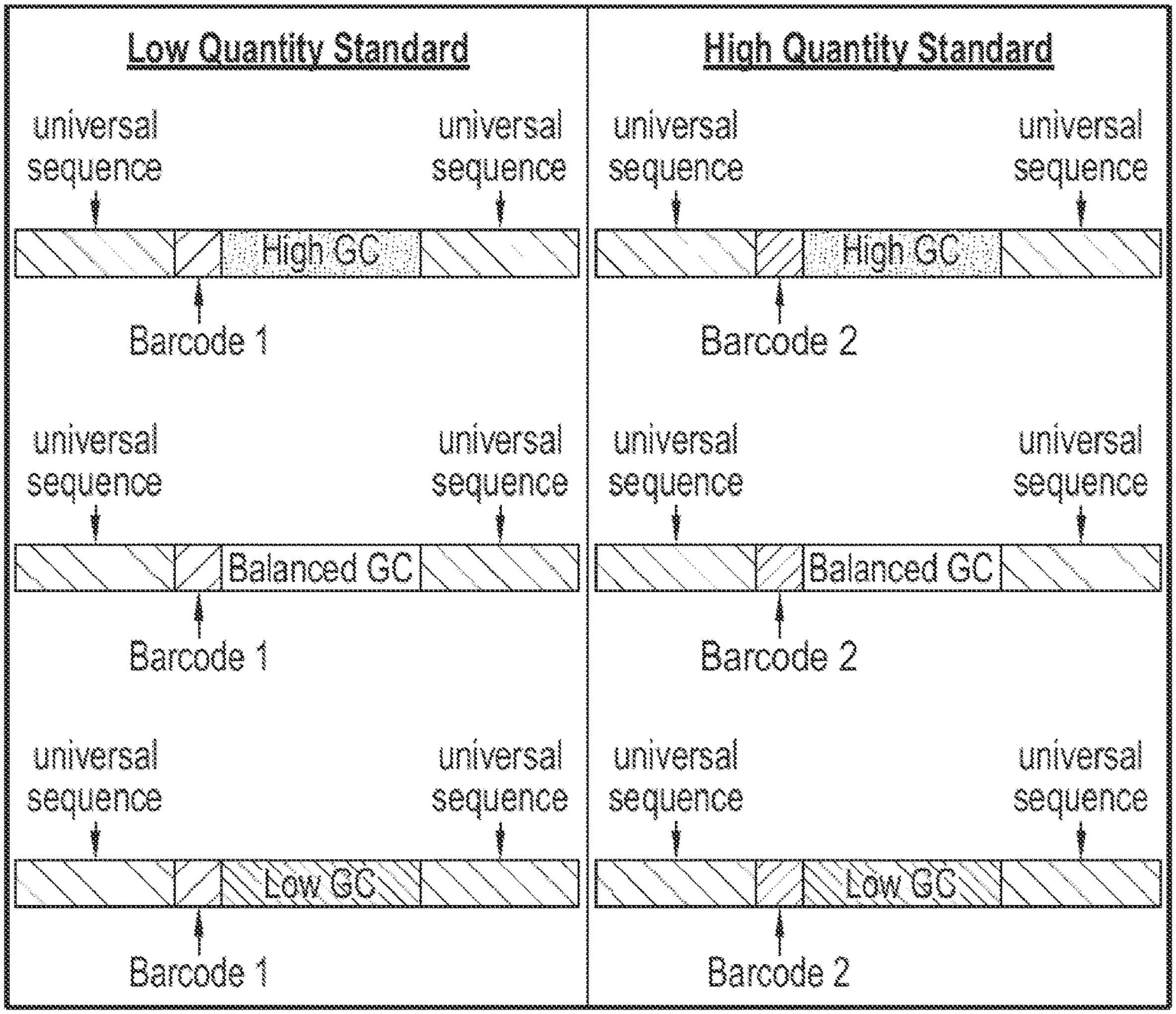
FIG. 11 shows a schematic of exemplary quantification spike-in control nucleic acid constructs where the nucleic acid constructs include universal sequence fragments for bioinformatic analysis, and where exemplary low concentration quantification nucleic acid constructs include a barcode sequence fragment (barcode 1), and exemplary high concentration quantification nucleic acid constructs include a barcode sequence fragment (barcode 2) that is different than the barcode sequence fragment in the low concentration quantification nucleic acid constructs. The schematic also exemplifies nucleic acid constructs with a low GC content fragment, a balanced GC content fragment, and a high GC content fragment.
Figure 12:
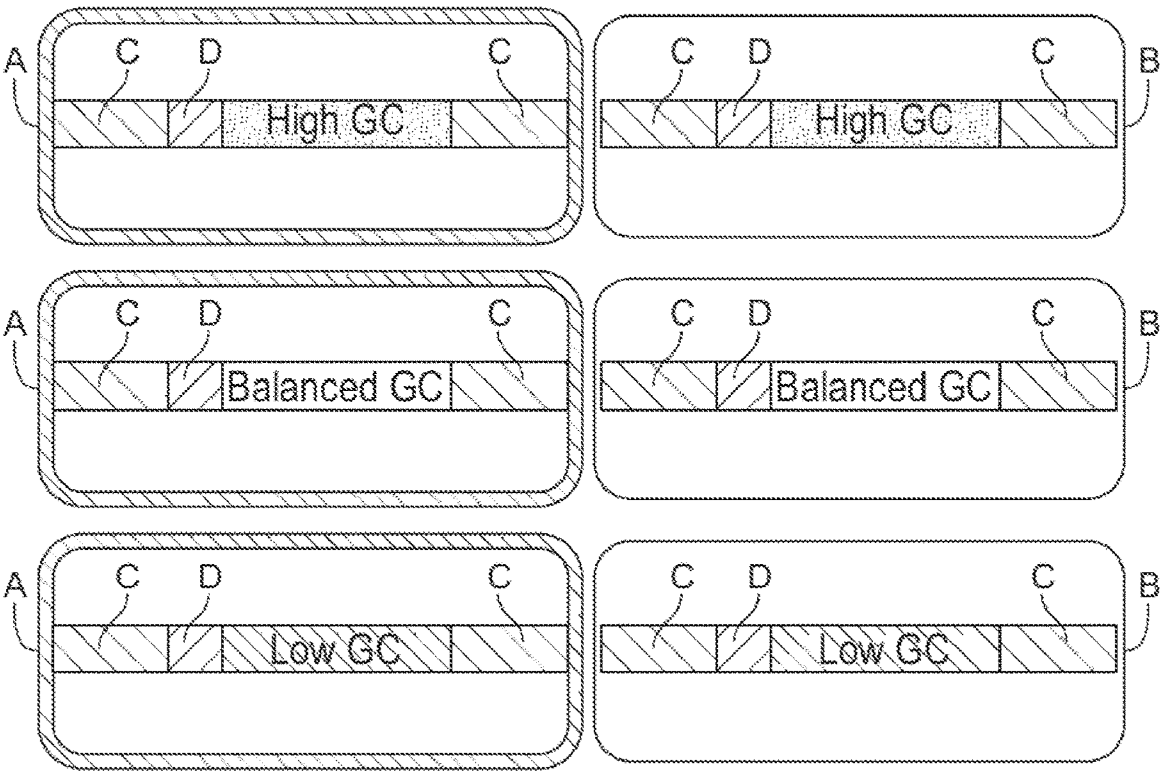
FIG. 12 shows a schematic of exemplary quantification spike-in control nucleic acid constructs encapsulated within simulated cell membranes highly resistant to lysis (A) and within non-resistant (easy to lyse) simulated cell membranes (B). The highly resistant cell membranes (e.g., liposomes) include, for example, lipid formulations with higher crystal transition temperatures, and higher amounts of LPS, PG, teichoic acids, PEG, cholesterol, and/or cationic lipids to condense the nucleic acid constructs. The non-resistant simulated cell membranes may, for example, omit the preceding ingredients or include them to a lesser degree.

By using the same type of nucleic acid construct, but with different barcode sequence fragments, different quantities of the nucleic acid construct can be spiked into samples (see the "Low Quantity Standard" and the "High Quantity Standard" with "Barcode 1" and "Barcode 2", respectively in FIG. 11), and a standard curve for quantitation can be produced. In this quantitation embodiment, the different GC content fragments (e.g., low, balanced, and high GC content) have the same barcode sequence fragment at each GC percentage (e.g., low, balanced, and high GC content), but for each separate concentrations of the nucleic acid constructs used to produce the standard curve (see the "Low Quantity Standard" and the "High Quantity Standard" in FIG. 11), the barcode sequence fragments are different so they can be differentiated post-sequencing. In this quantitation embodiment, the nucleic acid construct can be present at at least two, three, four or five different concentrations for use in generating a standard curve for the quantification of nucleic acids during sequencing.

Various embodiments of the GC content fragments are shown below in Tables 4 through 7.

TABLE 4

| Amplicon based controls | SEQ ID NO: | Forward Primer Binding Site Fragment | 5' Universal Sequence Fragment | Barcode Sequence Fragment | GC Content Fragment | 3' Universal Sequence Fragment | Reverse Primer Binding Site Fragment |
|---|---|---|---|---|---|---|---|
| 20%GC/80%AT controlseq1 | 2939 | CCTACGGGAGGCATCAG | GCAGATCTCG | TCCCTTGTCTCCACGAGACTGATT | ATGATTACAGTTAACAGTATCTTAATGATTACAGTTAACAGTATCTTA | AGTCAGTCAGCC | GGATTAGATACCCTAGTAGTC |
| 50%GC/50%AT controlseq1 | 2940 | CCTACGGGAGGCATCAG | GCAGATCTCG | TCCCTTGTCTCCACGAGACTGATT | CTGACTGCAGTTAGCAGTACCTGAATGCTGACAGTCAGCAGTACCTGA | AGTCAGTCAGCC | GGATTAGATACCCTAGTAGTC |
| 70%GC/30%AT controlseq1 | 2941 | CCTACGGGAGGCATCAG | GCAGATCTCG | TCCCTTGTCTCCACGAGACTGATT | CGACGGCTCAGGCCTCAGCGTGGCCGACGGCTGAGGCCTCAGCGTGGC | AGTCAGTCAGCC | GGATTAGATACCCTAGTAGTC |
| 20%GC/80%AT controlseq2 | 2942 | CCTACGGGAGGCATCAG | GCAGATCTCG | GCTGTACGGATTATCACCAGGTGT | ATGATTACAGTTAACAGTATCTTAATGAATTACAGTTAACAGTATCTTAGCC | AGTCAGTCAGCC | GGATTAGATACCCTAGTAGTC |
| 50%GC/50%AT controlseq2 | 2943 | CCTACGGGAGGCATCAG | GCAGATCTCG | GCTGTACGGATTATCACCAGGTGT | CTGACTGCAGTTAGCAGTACCTGAATGCTGACAGTCAGCAGTACCTGA | AGTCAGTCAGCC | GGATTAGATACCCTAGTAGTC |
| 70%GC/30%AT controlseq2 | 2944 | CCTACGGGAGGCATCAG | GCAGATCTCG | GCTGTACGGATTATCACCAGGTGT | CGACGGCTCAGGCCTCAGCGTGGCCGACGGCTGAGGCCTCAGCGTGGC | AGTCAGTCAGCC | GGATTAGATACCCTAGTAGTC |

TABLE 5

| Full sequence |
|---|
| CCTACGGGAGGCATCAGGCAGATCTCGTCCCTTGTCTCCACGAGACTGATTATGATTACAGTTAACAGTATCTTAATGATTACAGTTAACAGTATCTTAAGTCAGTCAGCCGGATTAGATACCCTAGTAGTC (SEQ ID NO: 2945) |
| CCTACGGGAGGCATCAGGCAGATCTCGTCCCTTGTCTCCACGAGACTGATTCTGACTGCAGTTAGCAGTACCTGAATGCTGACAGTCAGCAGTACCTGAAGTCAGTCAGCCGGATTAGATACCCTAGTAGTC (SEQ ID NO: 2946) |
| CCTACGGGAGGCATCAGGCAGATCTCGTCCCTTGTCTCCACGAGACTGATTCGACGGCTCAGGCCTCAGCGTGGCCGACGGCTGAGGCCTCAGCGTGGCAGTCAGTCAGCCGGATTAGATACCCTAGTAGTC (SEQ ID NO: 2947) |
| CCTACGGGAGGCATCAGGCAGATCTCGGCTGTACGGATTATCACCAGGTGTATGATTACAGTTAACAGTATCTTAATGATTACAGTTAACAGTATCTTAAGTCAGTCAGCCGGATTAGATACCCTAGTAGTC (SEQ ID NO: 2948) |

TABLE 5-continued

| Full sequence |
|---|
| CCTACGGGAGGCATCAGGCAGATCTCGGCTGTACGGATTATCACCAGGTGTCTGACTGCAGTTAGCAGTACCTGAATGCTGACAGTCAGCAGTACCTGA AGTCAGTCAGCCGGATTAGATACCCTAGTAGTC (SEQ ID NO: 2949) |
| CCTACGGGAGGCATCAGGCAGATCTCGGCTGTACGGATTATCACCAGGTGTCGACGGCTCAGGCCTCAGCGTGGCCGACGGCTGAGGCCTCAGCGTGGC AGTCAGTCAGCCGGATTAGATACCCTAGTAGTC (SEQ ID NO: 2950) |

TABLE 6

| WGS controls | SEQ ID NO: | 5' Universal Sequence Fragment | Barcode Sequence Fragment |
|---|---|---|---|
| 20%GC/80%AT controlseq1 | 2951 | **GCAGATCTCGTACG CGAA** | TCCCTTGTCTCCACGAGACTG ATT |
| 50%GC/50%AT controlseq1 | 2952 | **GCAGATCTCGTACG CGAA** | TCCCTTGTCTCCACGAGACTG ATT |
| 70%GC/30%AT controlseq1 | 2953 | **GCAGATCTCGTACG CGAA** | TCCCTTGTCTCCACGAGACTG ATT |
| 20%GC/80%AT controlseq2 | 2954 | **GCAGATCTCGTACG CGAA** | GCTGTACGGATTATCACCAG GTGT |
| 50%GC/50%AT controlseq2 | 2955 | **GCAGATCTCGTACG CGAA** | GCTGTACGGATTATCACCAG GTGT |
| 70%GC/30%AT controlseq2 | 2956 | **GCAGATCTCGTACG CGAA** | GCTGTACGGATTATCACCAG GTGT |

| WGS controls | GC Content Fragment | 3' Universal Sequence Fragment |
|---|---|---|
| 20%GC/80%AT controlseq1 | **ATGATTACAGTTAACAGTATCTTAATGATTACAG TTAACAGTATCTTA** | GTCATGACAGTCAGTCAGCC |
| 50%GC/50%AT controlseq1 | **CTGACTGCAGTTAGCAGTACCTGAATGCTGACAG TCAGCAGTACCTGA** | GTCATGACAGTCAGTCAGCC |
| 70%GC/30%AT controlseq1 | **CGACGGCTCAGGCCTCAGCGTGGCCGACGGCTG AGGCCTCAGCGTGGC** | GTCATGACAGTCAGTCAGCC |
| 20%GC/80%AT controlseq2 | **ATGATTACAGTTAACAGTATCTTAATGATTACAG TTAACAGTATCTTA** | GTCATGACAGTCAGTCAGCC |
| 50%GC/50%AT controlseq2 | **CTGACTGCAGTTAGCAGTACCTGAATGCTGACAG TCAGCAGTACCTGA** | GTCATGACAGTCAGTCAGCC |
| 70%GC/30%AT controlseq2 | **CGACGGCTCAGGCCTCAGCGTGGCCGACGGCTG AGGCCTCAGCGTGGC** | GTCATGACAGTCAGTCAGCC |

TABLE 7

| Full sequence |
|---|
| GCAGATCTCGTACGCGAATCCCTTGTCTCCACGAGACTGATTATGATTACAGTTAACAGTATCTTAATGATTACAGTTAACAGTATCTTAGTCA TGACAGTCAGTCAGCC (SEQ ID NO: 2957) |
| GCAGATCTCGTACGCGAATCCCTTGTCTCCACGAGACTGATTCTGACTGCAGTTAGCAGTACCTGAATGCTGACAGTCAGCAGTACCTGAGTC ATGACAGTCAGTCAGCC (SEQ ID NO: 2958) |
| GCAGATCTCGTACGCGAATCCCTTGTCTCCACGAGACTGATTCGACGGCTCAGGCCTCAGCGTGGCCGACGGCTGAGGCCTCAGCGTGGCGT CATGACAGTCAGTCAGCC (SEQ ID NO: 2959) |
| GCAGATCTCGTACGCGAAGCTGTACGGATTATCACCAGGTGTATGATTACAGTTAACAGTATCTTAATGATTACAGTTAACAGTATCTTAGTC ATGACAGTCAGTCAGCC (SEQ ID NO: 2960) |
| GCAGATCTCGTACGCGAAGCTGTACGGATTATCACCAGGTGTCTGACTGCAGTTAGCAGTACCTGAATGCTGACAGTCAGCAGTACCTGAGTC ATGACAGTCAGTCAGCC (SEQ ID NO: 2961) |
| GCAGATCTCGTACGCGAAGCTGTACGGATTATCACCAGGTGTCGACGGCTCAGGCCTCAGCGTGGCCGACGGCTGAGGCCTCAGCGTGGCGT CATGACAGTCAGTCAGCC (SEQ ID NO: 2962) |

In this quantitation embodiment, the GC content fragment can be from about 100 base pairs in length to about 270 base pairs in length, from about 100 base pairs in length to about 260 base pairs in length, from about 100 base pairs in length to about 250 base pairs in length, from about 100 base pairs in length to about 240 base pairs in length, from about 100 base pairs in length to about 230 base pairs in length, from about 100 base pairs in length to about 220 base pairs in length, from about 100 base pairs in length to about 210 base pairs in length, from about 100 base pairs in length to about 200 base pairs in length, from about 100 base pairs in length to about 190 base pairs in length, from about 100 base pairs in length to about 180 base pairs in length, from about 100 base pairs in length to about 170 base pairs in length, from about 100 base pairs in length to about 160 base pairs in length, from about 100 base pairs in length to about 150 base pairs in length, from about 100 base pairs in length to about 140 base pairs in length, from about 100 base pairs in length to about 130 base pairs in length, from about 100 base pairs in length to about 120 base pairs in length, from about 50 base pairs in length to about 270 base pairs in length, from about 50 base pairs in length to about 260 base pairs in length, from about 50 base pairs in length to about 250 base pairs in length, from about 50 base pairs in length to about 240 base pairs in length, from about 50 base pairs in length to about 230 base pairs in length, from about 50 base pairs in length to about 220 base pairs in length, from about 50 base pairs in length to about 210 base pairs in length, from about 50 base pairs in length to about 200 base pairs in length, from about 50 base pairs in length to about 190 base pairs in length, from about 50 base pairs in length to about 180 base pairs in length, from about 50 base pairs in length to about 170 base pairs in length, from about 50 base pairs in length to about 160 base pairs in length, from about 50 base pairs in length to about 150 base pairs in length, from about 50 base pairs in length to about 140 base pairs in length, from about 50 base pairs in length to about 130 base pairs in length, from about 50 base pairs in length to about 120 base pairs in length, from about 60 base pairs in length to about 120 base pairs in length, from about 70 base pairs in length to about 120 base pairs in length, from about 80 base pairs in length to about 120 base pairs in length, from about 90 base pairs in length to about 120 base pairs in length, or from about 100 base pairs in length to about 120 base pairs in length.

In quantitation embodiments where GC content fragments are present, the GC content of the GC content fragments can vary. As exemplary embodiments, the GC content fragments can have GC contents of about 1 to about 40 percent, about 1 to about 35 percent, about 1 to about 30 percent, about 1 to about 25 percent, about 1 to about 20 percent, about 35 to about 65 percent, about 40 to about 65 percent, about 40 to about 60 percent, about 40 to about 55 percent, about 40 to about 50 percent, about 45 to about 65 percent, about 45 to about 60 percent, about 45 to about 55 percent, about 45 to about 50 percent, about 65 to about 100 percent, about 65 to about 95 percent, about 65 to about 90 percent, about 65 to about 85 percent, about 65 to about 80 percent, about 65 to about 75 percent, about 65 to about 70 percent, about 60 to about 100 percent, about 60 to about 95 percent, about 60 to about 90 percent, about 60 to about 85 percent, about 60 to about 80 percent, about 60 to about 75 percent, or about 60 to about 70 percent. In one aspect, the GC content fragments can have low (e.g., about 1 to about 40 percent), balanced (e.g., about 40 to about 60 percent or about 45 to about 60 percent), or high GC content (e.g., about 60 to about 100 percent or about 65 to about 100 percent). In this quantitation embodiment, the GC content fragments in different nucleic acid constructs can have, for example, at least one, two, three, or four different GC content percentages in the different nucleic acid constructs.

In this quantitation embodiment, the different GC content fragments (e.g., low, balanced, and high GC content) have the same barcode sequence fragment at each GC percentage (e.g., low, balanced, and high GC content), but at each separate concentration of the nucleic acid construct used to produce the standard curve (e.g., "Low Quantity Standard" and the "High Quantity Standard" in FIG. 11), the barcode sequence fragments are unique to each concentration used to produce the standard curve.

In quantitation embodiments for amplicon sequencing, the nucleic acid construct can further comprise at least a first and a second primer binding site fragment. In this aspect, the primers can be any primers of interest. In this embodiment, the first primer binding site fragment is linked at its 3' end to the 5' end of the first universal sequence fragment and the second primer binding site fragment is linked at its 5' end to the 3' end of the second universal sequence fragment. In embodiments for whole genome sequencing, the nucleic acid construct may lack primer binding site fragments. In embodiments where primer binding site fragments are included in the nucleic acid construct, the primer binding site fragments can range in length from about 15 base pairs to about 28 base pairs, from about 15 base pairs to about 26 base pairs, from about 15 base pairs to about 24 base pairs, from about 15 base pairs to about 22 base pairs, from about 15 base pairs to about 20 base pairs, from about 16 base pairs to about 22 base pairs, from about 16 base pairs to about 20 base pairs, from about 17 base pairs to about 20 base pairs, or can be about 18 base pairs.

In an illustrative embodiment of the quantitation embodiment, the nucleic acid construct is a deoxyribonucleic acid construct. In another aspect, the nucleic acid construct is a ribonucleic acid. In another embodiment, the nucleic acid construct is incorporated into a plasmid. In yet another embodiment, the nucleic acid construct is incorporated into the genome of an organism.

In all of the various quantitation embodiments described above, the entire nucleic acid construct, not including plasmid sequence if a plasmid is present, can range in length from about 80 base pairs to about 300 base pairs, from about 80 base pairs to about 290 base pairs, from about 80 base pairs to about 280 base pairs, from about 80 base pairs to about 270 base pairs, from about 80 base pairs to about 260 base pairs, from about 80 base pairs to about 250 base pairs, from about 80 base pairs to about 240 base pairs, from about 80 base pairs to about 230 base pairs, from about 80 base pairs to about 220 base pairs, from about 80 base pairs to about 210 base pairs, from about 80 base pairs to about 200 base pairs, from about 80 base pairs to about 190 base pairs, from about 80 base pairs to about 180 base pairs, from about 80 base pairs to about 170 base pairs, or from about 80 base pairs to about 160 base pairs.

In another embodiment, any of the nucleic acids constructs, incorporated into a plasmid or not incorporated or encapsulated or not encapsulated, can be in the form of a kit. In this illustrative aspect, the kit can further comprise a reagent for nucleic acid extraction, a reagent for nucleic acid purification, a reagent for library preparation, a reagent for amplification, a probe (for example for use in exome/targeted hybridization sequencing as described below), a reagent for sequencing, a reagent for chemical analyses, such as mass spectrometry, and/or instructions for use of the kit. In this illustrative embodiment, the kit can comprise more than one of the control compositions for sequencing or chemical analyses wherein each control composition comprises a different nucleic acid construct wherein the different nucleic acid constructs comprise different barcode sequence fragments (e.g., the 384 barcode sequence fragments contained in SEQ ID NOS: 1 to 384 or SEQ ID NOS: 384 to 768, or, for example, a subset of 96 of these sequences for use in multiplex sequencing applications).

In yet another illustrative aspect, a kit for quantitation of nucleic acids during sequencing can comprise more than one of any of the control compositions described herein wherein each control composition comprises a different nucleic acid construct wherein the different nucleic acid constructs comprise different barcode sequence fragments. In this quantitation embodiment, the nucleic acid constructs comprising different barcode sequence fragments can be spiked into the sample at different concentrations (see the "Low Quantity Standard" and the "High Quantity Standard" with "Barcode 1" and "Barcode 2", respectively in FIG. 11), and a standard curve for quantitation can be produced. In this quantitation embodiment, each separate concentration of the nucleic acid construct used to produce the standard curve has different barcode sequence fragments so that the different concentrations can be differentiated post-sequencing.

Figure 13A:
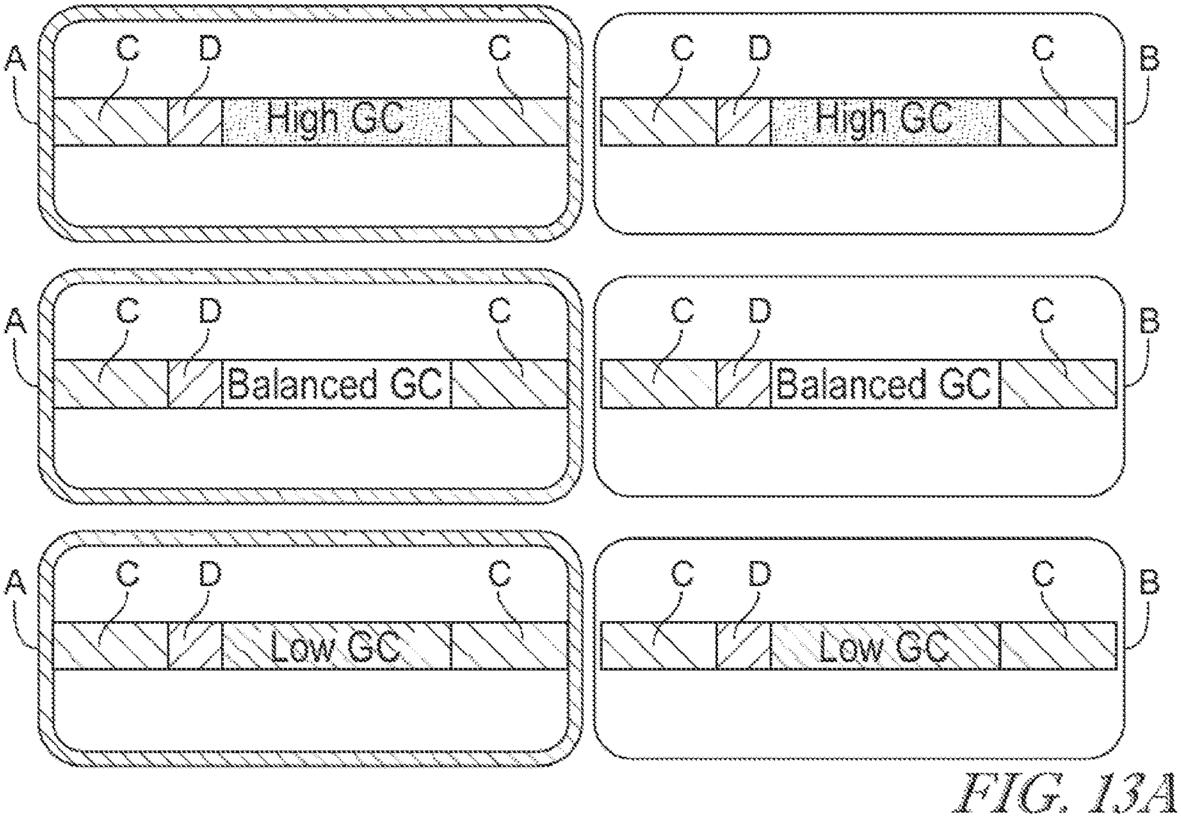
FIGS. 13A and B show a schematic of exemplary low (FIG. 13A) and high (FIG. 13B) concentration quantification nucleic acid constructs encapsulated in different simulated cell membranes to control for differential lysis during sample preparation and processing. Highly resistant (FIG. 13A) and non-resistant (FIG. 13B) simulated cell membranes contain nucleic acid constructs which include universal sequence fragments for bioinformatic analysis (C), a first barcode sequence fragment (barcode 1; D) for the lower concentration constructs, and a second barcode sequence fragment (barcode 2; D) for the higher concentration constructs. The schematic also exemplifies nucleic acid constructs with a low GC content fragment, a balanced GC content fragment, and a high GC content fragment. To apply the quantification standards to amplicon sequencing, a forward primer binding site fragment can be added to the nucleic acid construct on the 5' end of the 5' universal sequence fragment and a reverse primer binding site fragment can be added to the 3' end of the 3' universal sequence fragment. The amplicon sequencing constructs could be either linear or within plasmids.
Figure 13B:
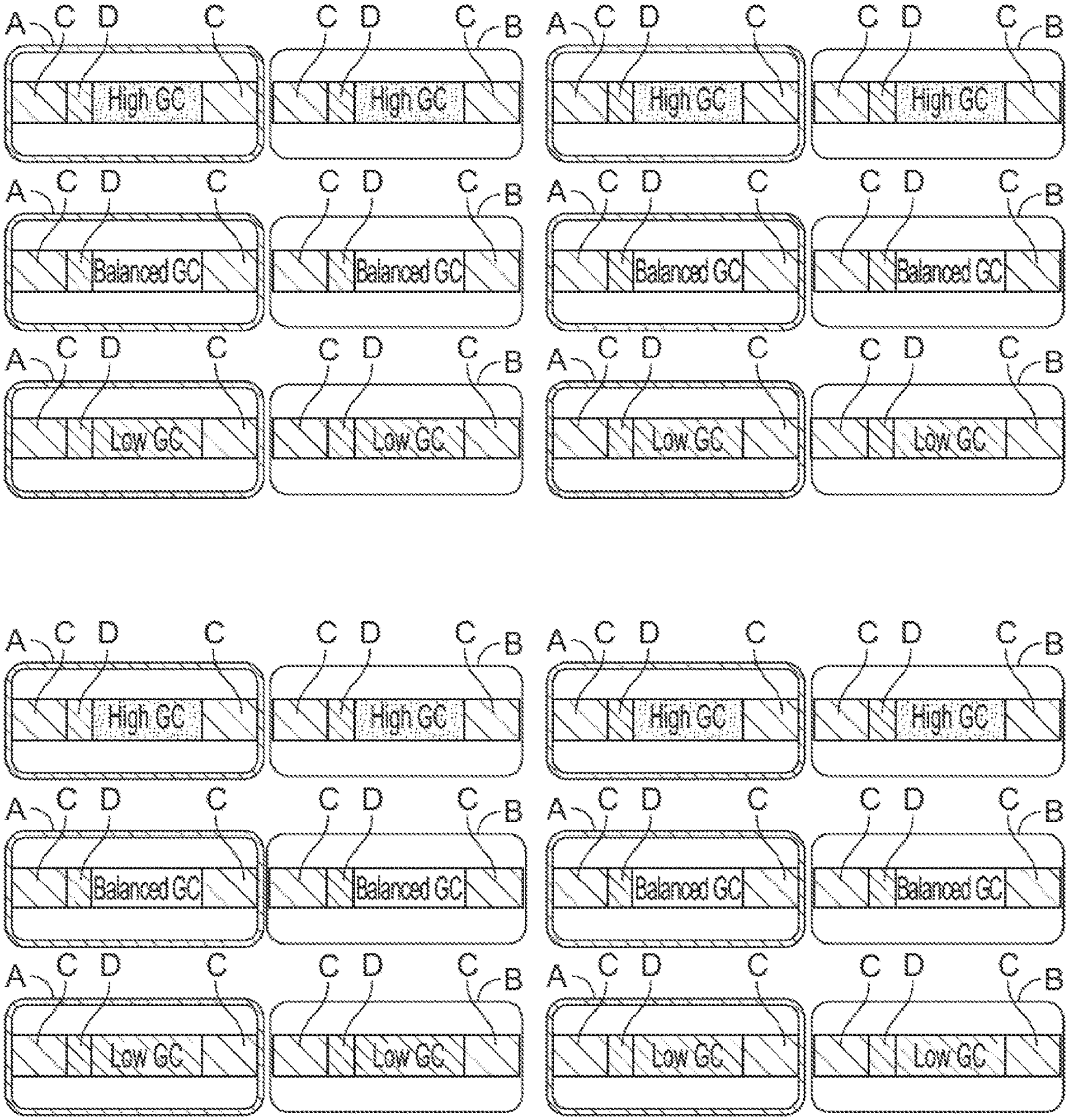

In yet another illustrative aspect, the kits described herein can comprise more than one of any of the control compositions described herein wherein the nucleic acid construct in each control composition is encapsulated in a different type of liposome. In this embodiment, each control composition wherein the nucleic acid construct is encapsulated in a different type of liposome may have a different barcode sequence fragment to differentiate the various types of liposomes post-sequencing (see FIG. 13).

In one embodiment, the probes for use in exome/targeted hybridization sequencing, primers for use in amplicon sequencing, whole genome sequencing, or exome/targeted hybridization sequencing, and the nucleic acid constructs, including nucleic acid constructs incorporated into a plasmid, described herein can be made by methods well-known in the art, including syntheses and recombinant methods. Such techniques are described in Sambrook et al., "Molecular Cloning: A Laboratory Manual", 3rd Edition, Cold Spring Harbor Laboratory Press, (2001), incorporated herein by reference. Plasmids, primers, probes, and the nucleic acid constructs described herein can also be made commercially (e.g., Blue Heron, Bothell, WA 98021). Techniques for purifying or isolating the probes, primers, or nucleic acid constructs, including nucleic acid constructs incorporated into a plasmid, described herein are well-known in the art. Such techniques are described in Sambrook et al., "Molecular Cloning: A Laboratory Manual", 3rd Edition, Cold Spring Harbor Laboratory Press, (2001), incorporated herein by reference. The nucleic acid constructs, including nucleic acid constructs incorporated into a plasmid, described herein can be analyzed by techniques known in the art, such as sequencing, to determine if the sequence is correct.

In one illustrative aspect, the nucleic acid construct, incorporated into a plasmid or not incorporated into a plasmid, can be encapsulated. In one exemplary embodiment, the nucleic acid construct, incorporated into a plasmid or not incorporated into a plasmid, can be encapsulated in a liposome, and the liposome can comprise a lipid selected from the group consisting of cholesterol, a cholesterol ester salt, a lipopolysaccharide, a sphingolipid, a peptidoglycan, a phospholipid, any other suitable lipid, and combinations thereof.

In this embodiment, liposomes can be closed, spherical vesicles comprising amphiphilic lipids in proportions such that they arrange themselves into multiple concentric bilayers when hydrated in aqueous solutions. In another aspect, the liposomes can be converted into single bilayer liposomes which are useful carriers of both hydrophilic molecules, which can reside entrapped in the aqueous interior of the liposome, and of hydrophobic molecules, which can reside entrapped in the lipid bilayer. An exemplary hydrophilic chain constituent is polyethylene glycol.

In various embodiments, the lipids can include those having two hydrocarbon chains, typically acyl chains, and a polar head group, such as phospholipids and glycolipids. In this aspect, phospholipids may include any one type of phospholipid or a combination of phospholipids capable of forming liposomes, including, but not limited to, phosphatidylcholines, phosphatidylethanolamine, phosphatidic acid, phosphatidylinositol, and sphingomyelin, where the two hydrocarbon chains are typically between about 14 to 22 carbons in length, and have varying degrees of unsaturation. The glycolipids include, but are not limited to, cerebrosides and gangliosides. Exemplary phosphatidylcholines, include those obtained from natural sources or those that are partially or wholly synthetic, or are of variable chain length and unsaturation.

In various embodiments, the nucleic acid construct can be encapsulated, incorporated into a plasmid or not incorporated into a plasmid, into a simulated cell membrane that mimics the cell membrane of the microorganism or a eukaryotic cell, or another cell of interest. In one illustrative embodiment, lipids with varying crystal transition temperatures, including cholesterol and lipopolysaccharide, can be incorporated during encapsulation to better mimic the mechanical and material characteristics of a microorganism cell wall (e.g., a bacterial cell wall). In this embodiment, variation in liposome production parameters such as the lipid:DNA ratio, the solvent:non-solvent ratio, and the lipid charge can be used to better tune the liposome composition and size to mimic the cell membrane of the microorganism or a eukaryotic cell, or another cell of interest.

For example, membrane rigidity may be increased with increasing amounts of cholesterol. In one embodiment, this allows the production of a range of liposomes that include easy to lyse (i.e., non-resistant liposomes) through difficult to lyse liposomes (i.e., resistant liposomes). In another embodiment, LPS may be used to mimic Gram-negative bacterial membranes. The hydrated saccharide chains can act as a barrier to hydrophobic species while the phospholipid layer can act as a barrier to hydrophilic species. A periplasm layer of water and peptidoglycan (PG) separates the LPS outer membrane from an inner membrane composed of a more conventional phospholipid lipid bilayer. Polyethylene Glycol (PEG) is a hydrophilic, biologically inert, synthetic material that may confer similar membrane robustness. The PEG can assemble into a brush-like layer on the outer membrane of the liposomes, and act as a hydrated barrier while also increasing the apparent size. Although PEG has been extensively used in liposomes for drug delivery, it may not have been demonstrated as an LPS mimic in an artificial cell. PG, teichoic acids, or similar materials can be added to mimic a Gram-positive cell wall, as the thick PG layers increase lysis resistance. In one aspect, after synthesis, liposome size can be adjusted by extruding the liposomes through a filter membrane with well-defined pore sizes. In this embodiment, the final liposome will comprise small, unilamellar vesicles with a size that is determined by the pore size in the membrane used for extrusion. With no extrusion step, the liposomes may be larger, multi-lamellar liposomes.

In one illustrative aspect, direct encapsulation of the nucleic acid construct without a plasmid or genome backbone (shown schematically in FIG. 7A), may be beneficial for whole genome sequencing applications, because there will not be extraneous DNA that could affect whole genome sequencing using non-targeted approaches.

Figure 6A:
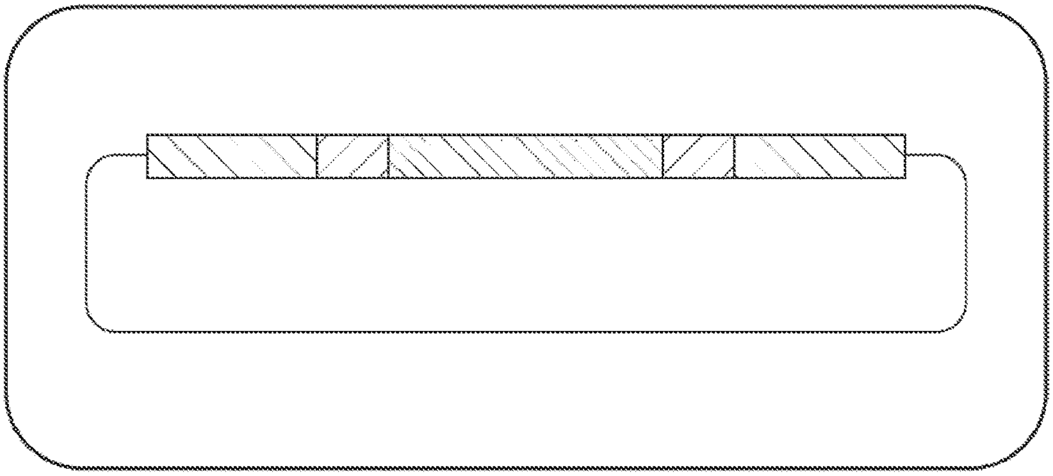
FIG. 6A shows schematically the exemplary nucleic acid construct of FIG. 5 as described herein cloned into a plasmid for amplicon sequencing applications.
Figure 6B:
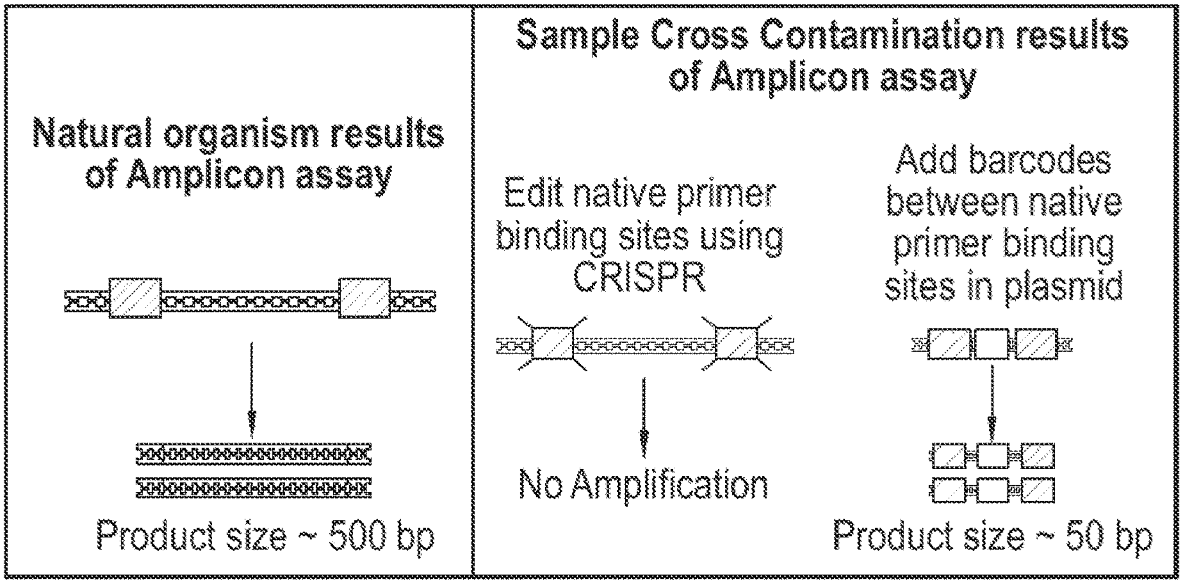
FIG. 6B shows schematically the exemplary nucleic acid construct of FIG. 5 as described herein inserted into the genome of a microorganism. In one aspect, the microorganism could be modified utilizing gene editing (e.g., CRISPR) so that the natural primer binding sites are removed before inserting the nucleic acid construct described herein into the genome of the microorganism.

In all of the encapsulation embodiments described above, encapsulation of the control composition for sequencing or chemical analyses, including the nucleic acid construct, or by incorporation into the genome of a cell (e.g., a bacterial or eukaryotic cell) allows for the control composition for sequencing or chemical analyses to be used in every step of sequencing analysis or chemical analyses of an unknown test sample: from extraction to purification to library preparation, sequencing, or chemical analyses, and data analysis because degradation of the control sample can be avoided so that sample cross-contamination and sample swapping can be effectively monitored throughout the protocol. In another aspect for the quantitation embodiments described herein, the nucleic acid constructs can be encapsulated in a simulated cell membrane to control for differential lysis during sample preparation. In another illustrative aspect, encapsulation of the nucleic acid constructs described herein can enable simultaneous quantification that is controlled for extraction efficiency, cross contamination control, and extraction quality control In embodiments where the nucleic acid construct is not artificially encapsulated in, for example, a liposome, the nucleic acid construct can be incorporated into the genome of a microorganism for use as a control composition for sequencing. This embodiment is shown schematically in FIGS. 6A and B as is applicable to amplicon sequencing. If the primer binding sites are present in the microorganism to be utilized, the microorganism could be modified utilizing gene editing, for example, so that the natural primer binding sites are removed (see FIG. 6B). In another embodiment, the barcode sequence fragment could be inserted into the genome of a microorganism between natural primer binding sites. In one aspect, the microorganism could be modified utilizing gene editing so that the sequence between the natural primer binding sites is replaced with the barcode. In one aspect, the CRISPR/Cas9 system for genome editing could be used as well as other genome editing systems, such as ZFNs, custom designed homing endonucleases, and TALENS systems.

The CRISPR/Cas9 system for genome editing has benefits over other genome editing systems. In this embodiment, the Cas9 endonuclease is capable of introducing a double strand break into a DNA target sequence (e.g., the natural primer binding sites described above). In this aspect, the Cas9 endonuclease is guided by the guide polynucleotide (e.g., guide RNA) to recognize and optionally introduce a double strand break at a specific target site into the genome of a cell, such as a microorganism, a eukaryotic cell, or another cell of interest for use in the methods described herein. The Cas9 endonuclease can unwind the DNA duplex in close proximity to the genomic target site and cleaves both DNA strands upon recognition of a target sequence by a guide polynucleotide (e.g., guide RNA), but only if the correct protospacer-adjacent motif (PAM) is approximately oriented at the 3' end of the target. In this embodiment, the donor polynucleotide construct (e.g., the nucleic acid construct described herein) can then be incorporated into the genomic target site. Methods for using the CRISPR/Cas9 system for genome editing are well-known in the art.

In one illustrative aspect, for sequencing or chemical analyses, the nucleic acids in the sample (e.g., microorganisms such as bacteria or viruses) and the nucleic acids in the control composition for sequencing or chemical analyses (e.g., the nucleic acid construct incorporated or not incorporated into a plasmid or into the genome of a microorganism), are extracted and purified for analysis. In various embodiments, the preparation of the nucleic acids (e.g., DNA or RNA) can involve rupturing the cells that contain the nucleic acids (e.g., cells of a microorganism or the nucleic acid construct in a simulated cell membrane) and isolating and purifying the nucleic acids (e.g., DNA or RNA) from the lysate. Techniques for rupturing cells and for isolation and purification of nucleic acids (e.g., DNA or RNA) are well-known in the art. In one embodiment, for example, nucleic acids may be isolated and purified by rupturing cells using a detergent or a solvent, such as phenol-chloroform. In another aspect, nucleic acids (e.g., DNA or RNA) may be separated from the lysate by physical methods including, but not limited to, centrifugation, pressure techniques, or by using a substance with an affinity for nucleic acids (e.g., DNA or RNA), such as, for example, beads that bind nucleic acids. In one embodiment, after sufficient washing, the isolated, purified nucleic acids may be suspended in either water or a buffer. In another aspect, the nucleic acids (e.g., DNA or RNA) are “isolated” or “purified” before sequencing. In one embodiment, “isolated” means that the nucleic acids are removed from their normal environment. In another aspect, “purified” in the context of the nucleic acids that are sequenced means the nucleic acids are substantially free of other cellular material, or culture medium, or other chemicals used in the extraction process. In other embodiments, commercial kits are available, such as Qiagen™ (e.g., Qiagen DNeasy PowerSoil Kit™), Nuclisensm™, and Wizard™ (Promega), and Promegam™ for extraction and purification of nucleic acids. Methods for preparing nucleic acids for sequencing or chemical analyses and library preparation are also described in Green and Sambrook, “Molecular Cloning: A Laboratory Manual”, 4th Edition, Cold Spring Harbor Laboratory Press, (2012), incorporated herein by reference.

In one illustrative aspect, after preparation for sequencing of the nucleic acids in the sample (e.g., in microorganisms such as bacteria or viruses) and the nucleic acid constructs in the control compositions for sequencing or chemical analyses (e.g., nucleic acid construct incorporated or not incorporated into a plasmid or the genome of a microorganism), a library can be prepared, and the nucleic acids can be sequenced using any suitable sequencing method. In one embodiment, Next Generation Sequencing (e.g., using Illumina, ThermoFisher, or PacBio or Oxford Nanopore Technologies sequencing platforms), sequencing by synthesis, pyrosequencing, nanopore sequencing, or modifications or combinations thereof can be used.

In one embodiment, the sequencing can be amplicon sequencing. In another embodiment, the sequencing can be whole genome sequencing. Whole genome sequencing includes, for example, metagenomics, and is utilized heavily in environmental microbial community research, microbiome research, and cancer or human diagnostics. In another embodiment, the sequencing can be exome/targeted hybridization sequencing.

Figure 8A:
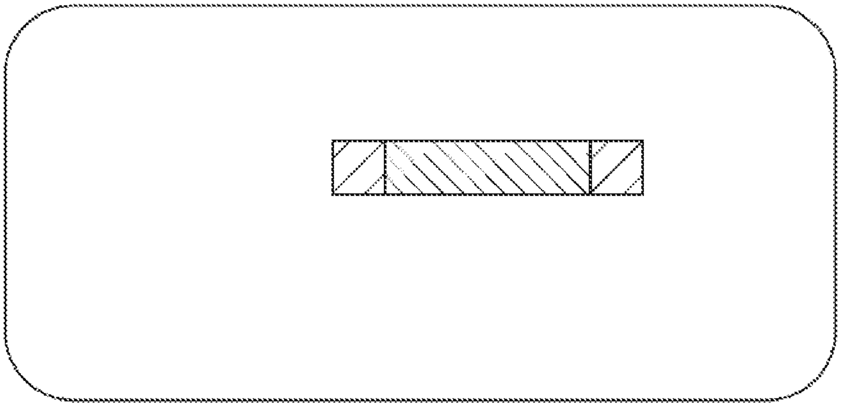
FIG. 8A shows schematically an exemplary construct for exome/targeted hybridization sequencing, encapsulated (e.g., in a liposome). In this example, the nucleic acid construct comprises universal sequence fragments flanking a barcode sequence fragment.
Figure 8B:
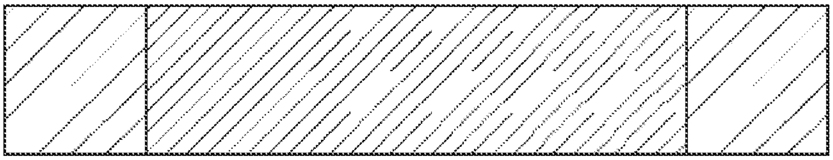
FIG. 8B shows schematically an exemplary probe for exome/targeted hybridization sequencing wherein the probe can be, for example, complementary to the universal sequence fragments (end fragments) with inosines in place of the barcode sequence fragment (middle fragment). Hybridization may occur between the nucleic acid construct of FIG. 8A and the probe of FIG. 8B, and the probe may be a streptavidin sequence probe which binds the sequence of interest, and then is bound to immobilized biotin to enrich the targeted sequences and remove sequences that are not of interest from the library. The targets can then be amplified prior to sequencing.

An exemplary nucleic acid construct and probe for exome/targeted hydridization sequencing is shown schematically in FIGS. 8A and B. In this embodiment, the nucleic acid construct comprises universal sequence fragments and a barcode sequence fragment between the universal sequence fragments (FIG. 8A). In this embodiment, if quantitation is used, GC content fragments can also be included. In this embodiment, the control composition for sequencing can be processed alongside the sample for whole genome sequencing: the control composition for sequencing is spiked into the sample, the DNA is extracted and purified, and a library preparation is conducted. Subsequently a hybridization can occur using streptavidin sequence probes, for example, to bind the nucleic acid construct and other sequences of interest. In this illustrative embodiment, other sequences are removed from the library, and the targets are amplified prior to sequencing. In this embodiment, the probe, at its ends, can be complementary to the universal sequence fragments in the nucleic acid construct, with inosines in the probe in place of the barcode sequence fragment to allow for hybridization of the probe to the universal sequence fragments in the nucleic acid construct. However, no hybridization occurs across the unique barcode sequence fragment to allow for sequencing after the amplification.

In one aspect, libraries can be pooled and concentrated before sequencing. Methods for library preparation and for sequencing are described in Green and Sambrook, "Molecular Cloning: A Laboratory Manual", 4th Edition, Cold Spring Harbor Laboratory Press, (2012), incorporated herein by reference. In one illustrative aspect, after sequencing, the number of reads (i.e., read counts) obtained by sequencing the nucleic acids in the sample or the nucleic acids in the control compositions for sequencing (e.g., nucleic acid construct incorporated or not incorporated into a plasmid or the genome of a microorganism) can be determined.

In various illustrative embodiments, using the control compositions for sequencing or chemical analyses described herein, patient samples or environmental samples (e.g., containing animal, plant, bacteria, viruses, fungi, or archaea) can be analyzed by sequencing or chemical analyses. In accordance with the invention, the term "patient" means a human or an animal, such as a domestic animal (e.g., a dog or a cat). Accordingly, the methods and control compositions for sequencing or chemical analyses described herein can be used, for example, for human clinical medicine (e.g., infectious disease diagnosis, cancer genomics, mendelian genetic testing, and paternity testing), veterinary applications, forensics, environmental or ecological use, and consumer sequencing services such as ancestry DNA, American Gut, or other amplicon sequencing-based technologies that sequence amplicons to determine ancestry or the consumer's microbiome composition.

In various aspects, the patient can be a human, or in the case of veterinary applications, can be a laboratory, agricultural, domestic or wild animal. In one embodiment, the patient can include, but is not limited to, a human, a laboratory animal such as a rodent (e.g., mice, rats, hamsters, etc.), a rabbit, a monkey, a chimpanzee, a domestic animal such as a dog, a cat, and a rabbit, and an agricultural animal such as a cow, a horse, a pig, a sheep, a goat, a chicken, and a wild animal in captivity such as a bear, a panda, a lion, a tiger, a leopard, an elephant, a zebra, a giraffe, a gorilla, a dolphin, and a whale.

In various illustrative embodiments, the samples that can be tested using the control compositions for sequencing or chemical analyses and the methods described herein comprise patient body fluids including, but not limited to, urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, such as seminal fluid, lymph fluid, and whole blood, serum, or plasma, or any other suitable patient sample. In another embodiment, nucleic acids extracted from microorganisms (e.g., bacteria or viruses) isolated or purified from patient samples or environmental samples can be tested using the control compositions for sequencing or chemical analyses and methods described herein. In various embodiments, patient tissue samples that can be tested by using the control compositions for sequencing or chemical analyses and the methods described herein can include tissue biopsies of hospital patients or out-patients and autopsy specimens. As used herein, the term "tissue" includes, but is not limited to, biopsies (including tumor biopsies), autopsy specimens, cell extracts, hair, tissue sections, aspirates, tissue swabs, and fine needle aspirates.

In various illustrative embodiments, environmental samples that can be tested by using the control compositions for sequencing or chemical analyses and the methods described herein can be selected from the group consisting of a soil sample, a water sample, a food sample, an air sample, a plant sample, an industrial waste sample, an agricultural sample, a surface wipe sample, a dust sample, a hair sample, and an animal sample, or any other suitable environmental sample.

In another illustrative embodiment, any of the unencapsulated or encapsulated nucleic acid constructs, incorporated into a plasmid or not incorporated into a plasmid, as described herein may be spiked into a sample that will undergo analysis by an analytical chemistry method, such as mass spectrometry, thermal analysis, electrochemical analysis, chromatographic analysis, and the like. In this embodiment, the analytical chemistry analysis may be quantitative and/or qualitative and the small molecules analyzed may be inorganic or organic compounds. In this aspect, the analysis may be selected from the group consisting of forensic analysis, environmental analysis, industrial analysis (e.g., quality control), or medical analysis. In this illustrative aspect, the nucleic acid construct samples can be extracted and treated in a similar fashion as the analytical chemistry samples, and archived samples, after the analytical chemistry analysis protocol is performed, can be saved for sequencing analysis of the cross-contamination or sample swapping controls. In this embodiment, forensic analysis, for example, may be stomach content analysis, checking blood alcohol content, monitoring substance abuse, toxin analysis, poison analysis, and the like. In this embodiment, the archived samples can be subjected to DNA sequencing to confirm or deny cross-contamination or sample swapping (e.g., at the time of sample collection).

In various illustrative embodiments, the microorganisms present in the patient sample or the environmental sample to be tested can be bacteria or viruses. In this aspect, the bacteria can be selected from Gram-negative and Gram-positive cocci and bacilli, and can comprise antibiotic-resistant bacteria. In another illustrative aspect, the bacteria can be selected from the group consisting of *Pseudomonas* species, *Staphylococcus* species, *Streptococcus* species, *Escherichia* species, *Haemophillus* species, *Neisseria* species, *Chlamydia* species, *Helicobacter* species, *Campylobacter* species, *Salmonella* species, *Shigella* species, *Clostridium* species, *Treponema* species, *Ureaplasma* species, *Listeria* species, *Legionella* species, *Mycoplasma* species, and *Mycobacterium* species, or the group consisting of *S. aureus, P. aeruginosa*, and *E. coli*. In another aspect, the viruses can be selected from DNA and RNA viruses, or can be selected from the group consisting of papilloma viruses, parvoviruses, adenoviruses, herpesviruses, vaccinia viruses, arenaviruses, coronaviruses, rhinoviruses, respiratory syncytial viruses, influenza viruses, picornaviruses, paramyxoviruses, reoviruses, retroviruses, and rhabdoviruses. In another illustrative embodiment, mixtures of any of these microorganisms can be present in the patient sample or the environmental sample. In yet another embodiment, the sample to be tested comprises eukaryotic cells.

In one illustrative aspect, a method is provided using any of the non-quantitation control compositions described herein. The method is for monitoring cross-contamination or sample swapping over all steps of a DNA sequencing protocol including collection of a sample comprising DNA, DNA extraction from the sample, purification of the extracted DNA, library preparation, and sequencing. The method comprises a) spiking the sample with a control composition comprising a nucleic acid construct wherein the nucleic acid construct comprises at least one barcode sequence fragment linked to at least one universal sequence fragment and wherein the nucleic acid construct is a deoxyribonucleic acid construct, b) extracting total DNA wherein total DNA comprises the DNA from the sample and DNA from the nucleic acid construct, c) purifying total DNA, d) preparing a library from total DNA, e) sequencing the extracted, purified total DNA, and f) detecting the nucleic acid construct in total DNA.

In another embodiment, a method is provided using any of the quantitation control compositions described herein that contain GC content fragments, where the method is for monitoring sample cross-contamination and/or sample swapping and for quantification of nucleic acids during sequencing. The method comprises a) extracting DNA from a sample, b) purifying the DNA, c) spiking the sample, after DNA extraction and purification and before library preparation, with a control composition comprising a nucleic acid construct wherein the nucleic acid construct comprises at least one barcode sequence fragment, at least one universal sequence fragment, and at least one GC content fragment, and wherein the nucleic acid construct is a deoxyribonucleic acid construct, wherein total DNA is obtained after spiking the sample, and wherein total DNA comprises the DNA from the sample and the DNA from the nucleic acid construct, d) preparing a library from total DNA, e) sequencing total DNA, and f) detecting and quantifying the nucleic acid construct in total DNA.

In another embodiment, a method is provided using any of the quantitation control compositions described herein that contain GC content fragments. The method is for monitoring sample cross-contamination and/or sample swapping and for quantification of nucleic acids during sequencing. The method comprises a) spiking a sample with a control composition comprising a nucleic acid construct wherein the nucleic acid construct comprises at least one barcode sequence fragment, at least one universal sequence fragment, and at least one GC content fragment and wherein the nucleic acid construct is a deoxyribonucleic acid construct, b) extracting total DNA from the sample wherein total DNA comprises the DNA from the sample and the DNA from the nucleic acid construct, c) purifying total DNA, d) preparing a library from total DNA, e) sequencing total DNA, and f) detecting and quantifying the nucleic acid construct in total DNA.

In another illustrative aspect, a method is provided using any of the non-quantitation control compositions described herein. The method is for monitoring cross-contamination or sample swapping over steps of a DNA sequencing protocol including collection of a sample comprising DNA, DNA extraction from the sample, purification of the extracted DNA, library preparation, and sequencing. The method comprises a) spiking the sample, after DNA extraction and purification and before library preparation, with a control composition comprising a nucleic acid construct wherein the nucleic acid construct comprises at least one barcode sequence fragment, at least one universal sequence fragment, and wherein the nucleic acid construct is a deoxyribonucleic acid construct, wherein total DNA comprises the DNA from the sample and the DNA from the nucleic acid construct, b) extracting total DNA, c) purifying total DNA, d) preparing a library from total DNA, e) sequencing the extracted, purified total DNA, and f) detecting the nucleic acid construct in total DNA.

In another embodiment, a method for monitoring cross-contamination or sample swapping during an analytical chemistry protocol is provided. The method comprises a) spiking an analytical chemistry protocol sample with a control composition comprising a nucleic acid construct wherein the nucleic acid construct comprises at least one barcode sequence fragment linked to at least one universal sequence fragment and wherein the nucleic acid construct is a deoxyribonucleic acid construct; b) performing the analytical chemistry protocol; c) archiving a sample from the analytical chemistry protocol; d) extracting total DNA from the archived sample wherein total DNA comprises the DNA from the nucleic acid construct and DNA from the analytical chemistry protocol sample, if any; e) purifying total DNA; f) preparing a library from total DNA; g) sequencing the extracted, purified total DNA; and h) detecting the nucleic acid construct in total DNA.

Figure 9:
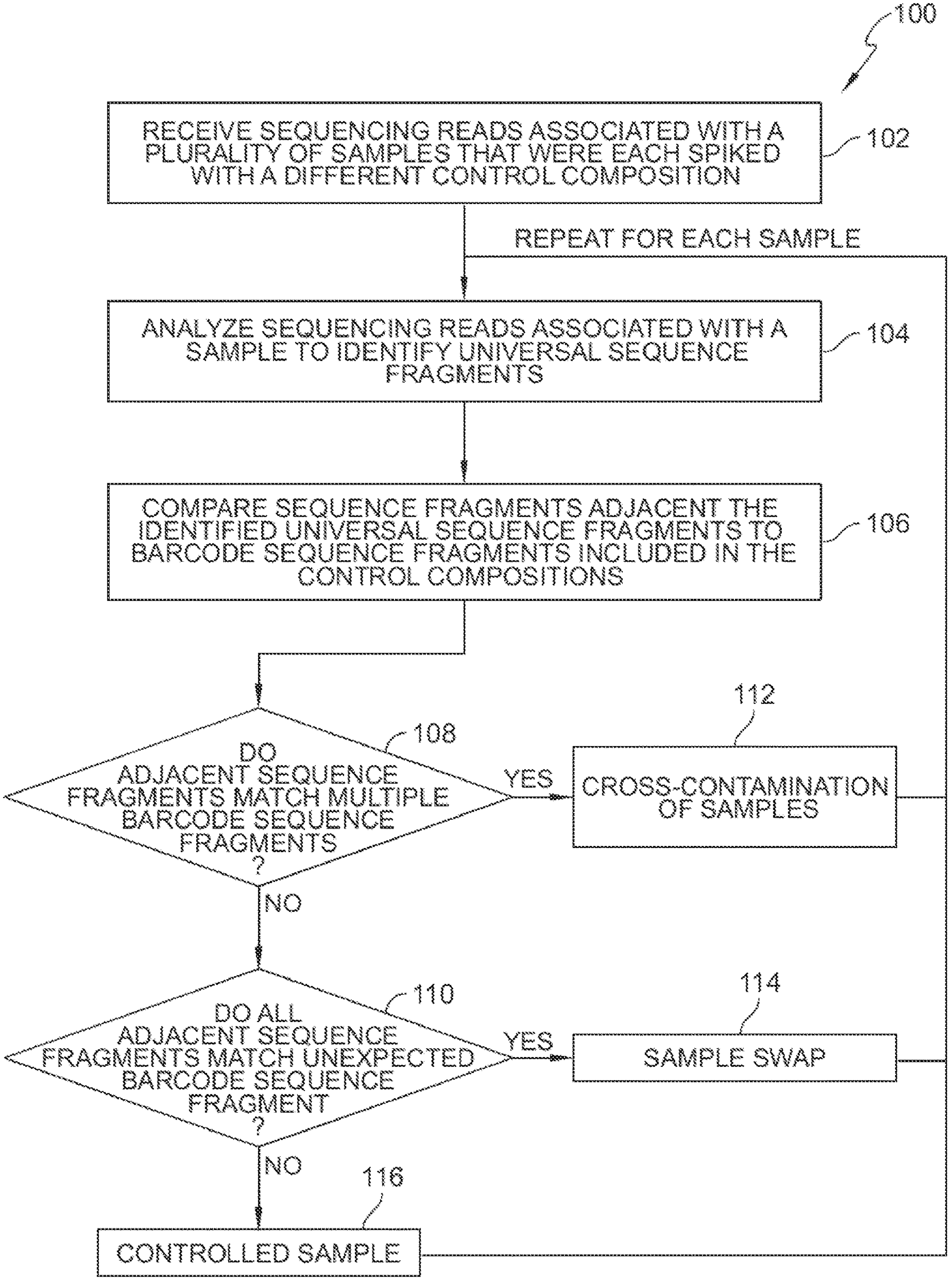
FIG. 9 is a simplified flow diagram illustrating one embodiment of a method for detecting cross-contamination or sample swapping using the presently disclosed control compositions.

Referring now to FIG. 9, an illustrative embodiment of a method 100 for detecting cross-contamination or sample swapping using the presently disclosed control compositions is shown as a simplified flow diagram. The method 100 may be performed by a computing device and, more particularly, a processor of a computing device. As shown in FIG. 9, the method 100 includes a number of steps illustrated as blocks 102-110. It will be appreciated by those of skill in the art that, in other embodiments of the method 100, not all of the blocks 102-110 need be included, the blocks 102-110 may be executed in a different order than that shown in FIG. 9 and described below, and additional or different blocks, other than those shown in FIG. 9, may be included.

In the illustrative embodiment, the method 100 begins with block 102 in which a computing device receives sequencing reads associated a plurality of samples. The sequencing reads received in block 102 will typically have been generated during multiplex sequencing of the plurality of samples. As discussed above, each of the plurality of samples is spiked with a different control composition comprising a different nucleic acid construct, with each different nucleic acid construct comprising a different barcode sequence fragment, to allow for monitoring cross-contamination or sample swapping over all steps of a DNA sequencing protocol being applied to the plurality of samples. As such, the sequencing reads received in block 102 will include sequencing reads of the DNA found in each sample and DNA from the nucleic acid constructs of the control compositions spiked into the samples. Each sequencing read is associated with the sample from which it was read, either by the use of a tag or by grouping in a distinct data structure. Block 102 may involve receiving the sequencing reads in the form of one or more FASTA, FASTQ, or similar files.

After block 102, the method 100 proceeds to block 104 in which the computing device analyzes the sequencing reads associated with a particular sample to identify the presence of one or more universal sequence fragments. As discussed above, universal sequence fragments may be linked to the 5' end and/or the 3' end of the barcode sequence fragment to assist the bioinformatic software in locating and processing the barcode sequence fragments found in the nucleic acid constructs of the control compositions. In some embodiments, block 104 may involve using a text-matching algorithm to identify the presence of one or more universal sequence fragments in the sequencing reads. By way of example, if a 10-base pair universal sequence fragment is included in the nucleic acid constructs of the control compositions, block 104 may involve utilizing a text-matching algorithm to compare each string of 10 characters present in the sequencing reads to the 10 characters representing that 10-base pair universal sequence fragment. In some embodiments, block 104 may also involve referencing a database of universal sequence fragments that may be included in the nucleic acid constructs of the control compositions. In such embodiments, each text string present in the sequencing reads being analyzed may be compared to each of the text strings representing a universal sequence fragment in the database to identify any matches.

After block 104, the method 100 proceeds to block 106 in which the computing device compares sequence fragments that are adjacent the universal sequence fragments identified in block 104 to the barcode sequence fragments included in the nucleic acid constructs of the control compositions spiked into the samples. In some embodiments, where the barcode sequence fragments are linked to two universal sequence fragments (one at the 5' end of the barcode sequence fragment and another at the 3' end of the barcode sequence fragment), block 106 may involve comparing each sequence fragment located between two universal sequence fragments in a sequencing read (identified in block 104) to the barcode sequence fragments included in the nucleic acid constructs of the control compositions. In some embodiments, block 106 may involve using a text-matching algorithm to identify the barcode sequence fragment adjacent the universal sequence fragment(s). By way of example, block 106 may involve utilizing a text-matching algorithm to compare the text string representing the sequence fragment adjacent the universal sequence fragment(s) to a plurality of text strings representing the different barcode sequence fragments included in the nucleic acid constructs of the control compositions spiked into the samples. In some embodiments, block 106 may involve referencing a database of barcode sequence fragments that may be included in the nucleic acid constructs of the control compositions for this purpose.

After block 106, the method 100 proceeds to block 108 in which the computing device determines whether the sequence fragments analyzed in block 106 collectively match multiple barcode sequence fragments included in the nucleic acid constructs of the control compositions spiked into the samples. If no cross-contamination between samples has occurred, all of the barcode sequence fragments found in the sequencing reads associated with a particular sample will be identical and match only the barcode sequence fragment included in the nucleic acid construct of the control composition spiked into that sample. As such, if block 108 determines that the sequence fragments analyzed in block 106 collectively match multiple barcode sequence fragments, the method 100 proceeds to block 112 in which the computing device identifies a cross-contamination condition. If block 108 determines that all of the sequence fragments analyzed in block 106 are identical, the method 100 instead proceeds to block 110.

In block 110 of the method 100, the computing device determines whether the sequence fragments analyzed in block 106 all match an unexpected barcode sequence fragment included in the nucleic acid constructs of the control compositions spiked into the samples. The sequencing reads associated with each sample will be expected to include a particular barcode sequence fragment based upon the nucleic acid construct of the control composition spiked into that sample. As such, if block 110 determines that the sequence fragments analyzed in block 106 all match an unexpected barcode sequence fragment, the method 100 proceeds to block 114 in which the computing device identifies a sample swap condition. If block 110 determines that all of the sequence fragments analyzed in block 106 are identical and match the expected barcode sequence fragment, the method 100 instead proceeds to block 116 in which the computing device identifies a (normal) controlled sample condition.

After reaching any of blocks 112, 114, or 116 for each sample, the method returns to block 104 and repeats blocks 104-116 for the sequencing reads associated with another sample of the plurality of samples. This process repeats until the sequencing reads associated with each of the plurality of samples has been analyzed. As such, at the conclusion of the method 100, each of the plurality of samples will have been identified as subject to a cross-contamination condition, a sample swap condition, or a controlled sample condition.

Figure 10:
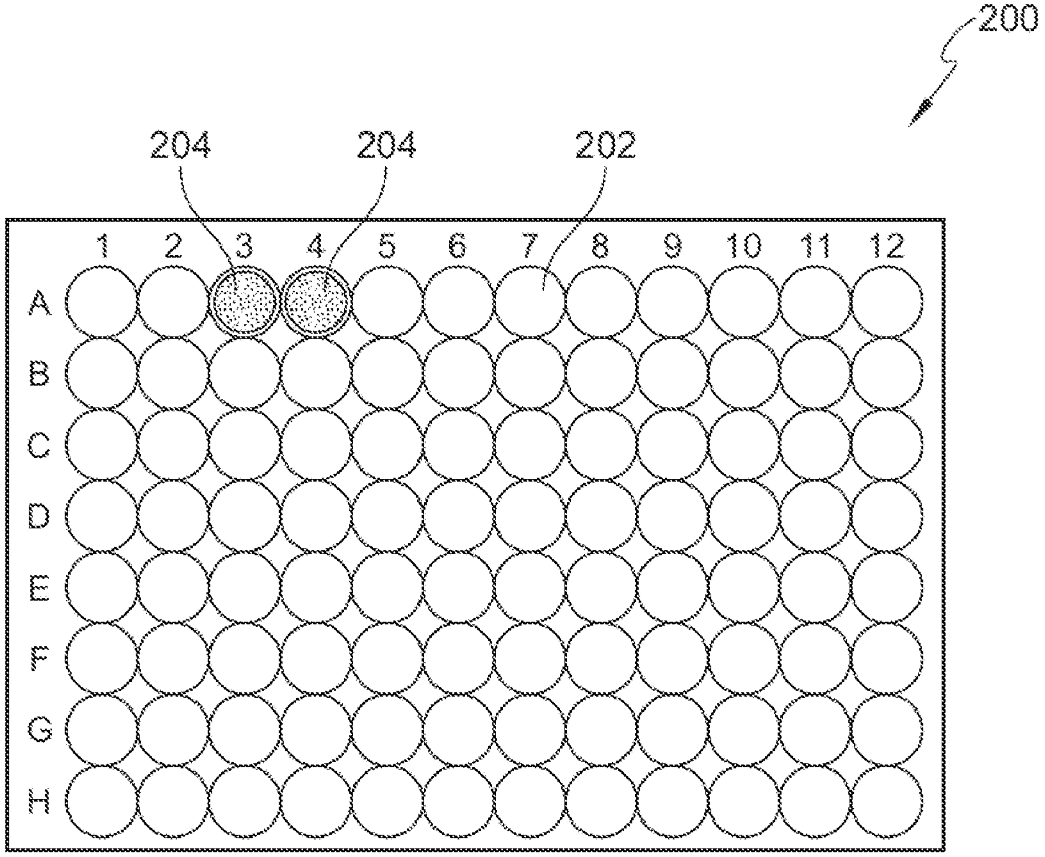
FIG. 10 is one embodiment of a graphic for displaying the results of the method of FIG. 9. Wells that have cross contamination are highlighted. This type of visual aid would enable researchers to identify cross-contamination or sample swapping, and to decide if a full plate will need to be re-run or only a few wells. The darker color in wells 3 and 4 indicates cross-contamination between wells A3 and A4.

FIG. 10 illustrates a simple graphic 200 that may be used for displaying the results of the method 100. In the illustrative embodiment shown in FIG. 10, the graphic 200 appears as a top-down view of 96-well sample plate. As will be appreciated by those skilled in the art, such samples plates are commonly used for multiplex processing and sequencing of a plurality of samples. In FIG. 10, the graphic 200 includes 96 icons 202, 204 (only three of which are labelled for clarity), with each icon 202, 204 representing one of the wells of a 96-well sample plate. It is contemplated that, in other embodiments, the graphic 200 may include greater or fewer icons 202, 204 to represent larger or smaller sample plates and/or a different number of samples being processed.

For each sample identified as subject to a controlled sample condition by the method 100, the graphic 200 includes a first icon 202 at a location corresponding to the well containing that sample. For each sample identified as subject to a cross-contamination condition by the method 100, the graphic 200 includes a second icon 204 at a location corresponding to the well containing that sample. For each sample identified as subject to a sample swap condition by the method 100, the graphic 200 may include a third icon (not shown) at a location corresponding to the well containing that sample. The first icon 202, second 204, and third icon may each be visually distinct from one another, allowing a user observing graphic 200 to quickly identify which samples are subject to which conditions. It is contemplated that in some embodiments, the graphic 200 may provide additional information on each sample, particularly in response to user interaction with the graphic 200. For instance, where a user clicks on and/or hovers over one of the icons 202, 204 with a mouse pointer, the graphic 200 may display additional information related to the sample represented by that icon, such as the barcode sequence fragment(s) found in that sample and their amounts (e.g., in number of reads or percentage of total reads).

The following examples are for illustrative purposes only. The examples are not intended to limit the invention in any way.

Example 1

Protocol for Use of Control Compositions for Sequencing

The goal was to encapsulate the CCC-1 and CCC-2 DNA (see description below) in a synthetic cell wall-like membrane that would mimic a natural bacterium, and to verify the encapsulation through spectrophotometric analysis (UV absorbance, or fluorescence), and then to test the encapsulated CCC-1 and CCC-2 DNA molecules for use as control compositions for sequencing (as described herein) in a spiked soil sample using amplicon sequencing.

Encapsulation Protocol

The Thin Film Hydration method is a viable liposome production method due to its applicability to the small volumes used for pDNA (plasmid DNA—CCC-1 and CCC-2 DNA) samples. Stock pDNA (plasmid DNA—CCC-1 and CCC-2 DNA) was purchased (see below), and only 5 μL of pDNA (at 10 μg/mL) is required for an amplicon sequencing test. The thin film hydration method (without extrusion) yields a small volume of liposomes with good yield.

Materials

| Item | Abbr. |
|---|---|
| Dipalmitoyl-sn-glycero-3-phosphocholine (DPPC) | DPPC |
| Cholesterol | CHOL |
| 1,2-dipalmitoyl-sn-glycero-3-phosphoethanolamine-N-[methoxy(poly(ethylene glycol))-2000] (ammonium salt) | DPPE-PEG |
| Lipopolysaccharides (rough strains) from *Escherichia coli* EH100 (Ra mutant) | LPS-Ra |

The encapsulation methods involved generating a standard calibration curve of pDNA in a UV transparent 96-well plate and reading the absorbance at 260 nm. To a micro-vial, 781 μL of ethanol was added. Then 16 μL of pDNA at 841 μg/mL (i.e. ng/μL) was added. The resulting solution was 98% ethanol with 20 μg/mL pDNA. This is the standard solution. CCC-1 and CCC-2 DNA was quantitated as described in FIG. 1 before encapsulation.

200 μL of ethanol was then added to wells B-H of columns 1 and 2 of a 96-well plate. Then 400 μL of the pDNA standard solution was added to well A of columns 1 and 2 of the plate. A 2-fold, 8-step serial dilution was peformed, leaving row H as pure ethanol. The absorbance at 260 nm was then read.

To three separate 1-dram glass vials, the mass of lipids shown in Table 8 below was weighed. The actual masses were recorded and the required volume of chloroform was calculated to bring each lipid solution to its target concentration. The required volume of chloroform to add is shown under Vol solvent, add. Then the three lipid solutions were mixed by combining 1.25 mL of each in a single container.

TABLE 8

| Lipid Type | Target mass, $M_{Target}$ (mg) | Target Concentration, $C_{Target}$ (mg/mL) | Actual Mass, $M_{Actual}$ (mg) | $V_{solvent,add}$ (mL) | $V_{stock,add}$ (mL) |
|---|---|---|---|---|---|
| DPPC | 30.9 | 24.701 | 32.5 | 1.316 | 1.25 |
| CHOL | 9.5 | 7.590 | 11 | 1.449 | 1.25 |
| PEG 2000 | 9.6 | 7.710 | 11.6 | 1.505 | 1.25 |
| Chloroform | | | | | 1.25 |

The lipid solution was added to the round bottom flask and the chloroform was removed to yield a thin film. To a 1-dram glass vial, 2.5 mL of Tris-EDTA buffer was added. Then 59 μL of pDNA at 841.7 μg/mL (i.e. ng/μL) was added to the vial, and vortexed briefly to disperse the DNA. Then the pDNA solution (2.5 mL) was added to the flask, and the flask was vortexed at room temperature until the lipid film dissolved. This yielded a white turbid dispesion of pDNA encapsulated in liposomes. The solution was stored in the refrigerator until use.

Spike-In Protocol

Each 0.25 gram soil sample was spiked with either 12.5 ng of CCC-1 DNA, CCC-2 DNA, or a mixture of CCC-1 and CCC-2 DNA, encapsulated as described above. The average size of the encapsulated CCC-1 DNA or CCC-2 DNA (each include a plasmid) was 8±2 μm in diameter, and encapsulation efficiency was demonstrated to be ~85%. The CCC-1 and CCC-2 DNA molecules are plasmids comprising a barcode sequence fragment and were purchased from Blue Heron, Bothell, WA 98021. The CCC-1 DNA and CCC-2 DNA sequences, including the plasmid, are shown below as SEQ ID NOS: 769 and 770, respectively. The nucleic acid construct sequence within the CCC-1 DNA and CCC-2 DNA sequences are shown below as SEQ ID NOS: 771 and 772, respectively.

(SEQ ID NO: 769)

```
gtaacactggcagagcattacgctgacttgacgggacggcgcaagctcatgaccaaaatc
ccttaacgtgagttttcgttccactgagcgtcagaccccgtagaaaagatcaaaggatct
tcttgagatcctttttttctgcgcgtaatctgctgcttgcaaacaaaaaaaccaccgcta
ccagcggtggtttgtttgccggatcaagagctaccaactctttttccgaaggtaactggc
ttcagctcttatggtttcccaagctgcggtatcattgcagcactggggccagatggtaag
ccctcccgtatcgtagttatctacacgacggggagtcaggcaactatggatgaacgaaat
agacagatcgctgagataggtgcctcactgattaagcattggtaactgtcagaccaagtt
tactcatatatactttagattgatttaaaacttcatttttaatttaaaaggatctaggtg
aagatcctttttgataatctcatgaccaaaatcccttaacgtgagttttcgaccactga
gcgtcagaccccgtagaaaagatcaaaggatcttcttgagatcttttttttctgcgcgta
```

atctgctgcttgcaaacaaaaaaaccaccgctaccagcggtggtttgtttgccggatcaa gagctaccaactctttttccgaaggtaactggcttcagcagagcgcagataccaaatact gttcttctagtgtagccgtagttaggccaccacttcaagaactctgtagcaccgcctaca tacctcgctctgctaatcctgttaccagtggctgctgccagtggcgataagtcgtgtctt accgggttggactcaagacgatagttaccggataaggcgcagcggtcgggctgaacgggg ggttcgtgcacacagcccagcttggagcgaacgacctacaccgaactgagatacctacag cgtgagctatgagaaagcgccacgcttcccgaagggagaaaggcggacaggtatccggta agcggcagggtcggaacaggagagcgcacgagggagcttccagggggaaacgcctggtat ctttatagtcctgtcgggtttcgccacctctgacttgagcgtcgatttttgtgatgctcg tcaggggggcggagcctatggaaaaacgccagcaacgcggcctttttacggttcctggcc ttttgctggccttttgctcacatgttctttcctgcgttatcccctgattctgtggataac cgtattaccgcctttgagtgagctgataccgctcgccgcagccgaacgaccgagcgcagc gagtcagtgagcgaggaagcggaagagcgcccaatacgcaaaccgcctctccccgcgcgt tggccgattcattaatgcagctggcacgacaggtttcccgactggaaagcgggcagtgag cgcaacgcaattaatgtgagttagctcactcattaggcaccccaggctttacactttatg cttccggctcgtatgttgtgtggaattgtgagcggataacaatttcacacaggaaacagc tatgaccatgattacgccaagctgcgatccggatctggatccagatcgggatctggatca agcttggatcctatctcctttccctacgggaggcatcaggcagatctcgtcccttgtctccacgagactgattagtcagtca gccggattagataccctagtagtcgaaagttgagaccatggaattcgatctggatcttgatccggatcacgatctcgatcaatt cactggccgtcgttttacaacgtcgtgactgggaaaaccctggcgttacccaacttaatc gccttgcagcacatccccctttcgccagctggcgtaatagcgaagaggcccgcaccgatc gcccttcccaacagttgcgcagcctgaatggcgaatggcgcctgatgcggtattttctcc ttacgcatctgtgcggtatttcacaccgcatacgtcaaagcaaccatagtacgcgccctg tagcggcgcattaagcgcggcgggtgtggtggttacgcgcagcgtgaccgctacacttgc cagcgccttagcgcccgctcctttcgctttcttcccttcctttctcgccacgttcgccgg ctttccccgtcaagctctaaatcgggggctccctttagggttccgatttagtgctttacg gcacctcgaccccaaaaaacttgatttgggtgatggttcacgtagtgggccatcgccctg atagacggtttttcgccctttgacgttggagtccacgttctttaatagtggactcttgtt ccaaactggaacaacactcaactctatctcggtcttatggtttcccaagctggcctcgtg atacgcctatttttataggttaatgtcatgggggggggggggaaagccacgttgtgtctc aaaatctctgatgttacattgcacaagataaaaatatatcatcatgaacaataaaactgt ctgcttacataaacagtaatacaaggggtgttatgagccatattcaacgggaaacgtcga ggccgcgattaaattccaacatggatgctgatttatatgggtataaatgggctcgcgata atgtcgggcaatcaggtgcgacaatctatcgcttgtatgggaagcccgatgcgccagagt tgtttctgaaacatggcaaaggtagcgttgccaatgatgttacagatgagatggtcagac taaactggctgacggaatttatgcctcttccgaccatcaagcattttatccgtactcctg atgatgcatggttactcaccactgcgatccccggaaaaacagcattccaggtattagaag aatatcctgattcaggtgaaaatattgttgatgcgctggcagtgttcctgcgccggttgc attcgattcctgtttgtaattgtccttttaacagcgatcgcgtatttcgtcttgctcagg cgcaatcacgaatgaataacggtttggttgatgcgagtgattttgatgacgagcgtaatg gctggcctgttgaacaagtctggaaagaaatgcataaacttttgccattctcaccggatt -continued cagtcgtcactcatggtgatttctcacttgataaccttatttttgacgaggggaaattaa
taggttgtattgatgttggacgagtcggaatcgcagaccgataccaggatcttgccatcc
tatggaactgcctcggtgagttttctccttcattacagaaacggctttttcaaaaatatg
gtattgataatcctgatgtgaataaattgcagtttcatttgatgctcgatgagtttttct
aatcagaattggttaattggtt (SEQ ID NO: 770)

gtaacactggcagagcattacgctgacttgacgggacggcgcaagctcatgaccaaaatc
ccttaacgtgagttttcgttccactgagcgtcagaccccgtagaaaagatcaaaggatct
tcttgagatcctttttttctgcgcgtaatctgctgcttgcaaacaaaaaaaccaccgcta
ccagcggtggtttgtttgccggatcaagagctaccaactctttttccgaaggtaactggc
ttcagctcttatggtttcccaagctgcggtatcattgcagcactggggccagatggtaag
ccctcccgtatcgtagttatctacacgacggggagtcaggcaactatggatgaacgaaat
agacagatcgctgagataggtgcctcactgattaagcattggtaactgtcagaccaagtt
tactcatatatactttagattgatttaaaacttcatttttaatttaaaaggatctaggtg
aagatcctttttgataatctcatgaccaaaatcccttaacgtgagttttcgttccactga
gcgtcagaccccgtagaaaagatcaaaggatcatttgagatcctttttttctgcgcgta
atctgctgcttgcaaacaaaaaaaccaccgctaccagcggtggtttgtttgccggatcaa
gagctaccaactttttaccgaaggtaactggcttcagcagagcgcagataccaaatact
gttcttctagtgtagccgtagttaggccaccacttcaagaactctgtagcaccgcctaca
tacctcgctctgctaatcctgttaccagtggctgctgccagtggcgataagtcgtgtctt
accgggttggactcaagacgatagttaccggataaggcgcagcggtcgggctgaacgggg
ggttcgtgcacacagcccagcttggagcgaacgacctacaccgaactgagatacctacag
cgtgagctatgagaaagcgccacgcttcccgaagggagaaaggcggacaggtatccggta
agcggcagggtcggaacaggagagcgcacgagggagcttccagggggaaacgcctggtat
ctttatagtcctgtcgggtttcgccacctctgacttgagcgtcgatttttgtgatgctcg
tcaggggggcggagcctatggaaaaacgccagcaacgcggcctttttacggttcctggcc
ttttgctggccttttgctcacatgttctttcctgcgttatcccctgattctgtggataac
cgtattaccgcctttgagtgagctgataccgctcgccgcagccgaacgaccgagcgcagc
gagtcagtgagcgaggaagcggaagagcgcccaatacgcaaaccgcctctccccgcgcgt
tggccgattcattaatgcagctggcacgacaggtttcccgactggaaagcgggcagtgag
cgcaacgcaattaatgtgagttagctcactcattaggcaccccaggctttacactttatg
cttccggctcgtatgttgtgtggaattgtgagcggataacaatttcacacaggaaacagc
tatgaccatgattacgccaagctgcgatccggatctggatccagatcgggatctggatca
agcttggatcctatctcctttccctacgggaggcatcaggcagatctcggctgtacggattatcaccaggtgtagtcagtca
gccggattagataccctagtagtcgaaagttgagaccatggaattcgatctggatcttgatccggatcacgatctcgatcaatt
cactggccgtcgttttacaacgtcgtgactgggaaaaccctggcgttacccaacttaatc
gccttgcagcacatccccctttcgccagctggcgtaatagcgaagaggcccgcaccgatc
gcccttcccaacagttgcgcagcctgaatggcgaatggcgcctgatgcggtattttctcc
ttacgcatctgtgcggtatttcacaccgcatacgtcaaagcaaccatagtacgcgccctg
tagcggcgcattaagcgcggcgggtgtggtggttacgcgcagcgtgaccgctacacttgc
cagcgccttagcgcccgctcctttcgctttcttcccttcctttctcgccacgttcgccgg -continued

```
ctttccccgtcaagctctaaatcgggggctccctttagggttccgatttagtgctttacg

gcacctcgaccccaaaaaacttgatttgggtgatggttcacgtagtgggccatcgccctg

atagacggtttttcgccctttgacgttggagtccacgttctttaatagtggactcttgtt

ccaaactggaacaacactcaactctatctcggtcttatggtttcccaagctggcctcgtg

atacgcctatttttataggttaatgtcatgggggggggggggaaagccacgttgtgtctc

aaaatctctgatgttacattgcacaagataaaaatatatcatcatgaacaataaaactgt

ctgcttacataaacagtaatacaaggggtgttatgagccatattcaacgggaaacgtcga

ggccgcgattaaattccaacatggatgctgatttatatgggtataaatgggctcgcgata

atgtcgggcaatcaggtgcgacaatctatcgcttgtatgggaagcccgatgcgcc agagt

tgtttctgaaacatggcaaaggtagcgttgccaatgatgttacagatgagatggtcagac

taaactggctgacggaatttatgcctcttccgaccatcaagcattttatccgtactcctg

atgatgcatggttactcaccactgcgatccccggaaaaacagcattccaggtattagaag

aatatcctgattcaggtgaaaatattgttgatgcgctggcagtgttcctgcgccggttgc

attcgattcctgtttgtaattgtccttttaacagcgatcgcgtatttcgtcttgctcagg

cgcaatcacgaatgaataacggtttggttgatgcgagtgattttgatgacgagcgtaatg

gctggcctgttgaacaagtctggaaagaaatgcataaacttttgccattctcaccggatt

cagtcgtcactcatggtgatttctcacttgataaccttatttttgacgaggggaaattaa

taggttgtattgatgttggacgagtcggaatcgcagaccgataccaggatcttgccatcc

tatggaactgcctcggtgagttttctccttcattacagaaacggctttttcaaaaatatg

gtattgataatcctgatgtgaataaattgcagtttcatttgatgctcgatgagtttttct

aatcagaattggttaattggtt

                                                  (SEQ ID NO: 771)
CCTACGGGAGGCATCAGGCAGATCTCGTCCCTTGTCTCCACGAGACTGATTAGTC

AGTCAGCCGGATTAGATACCCTAGTAGTC

                                                  (SEQ ID NO: 772)
CCTACGGGAGGCATCAGGCAGATCTCGGCTGTACGGATTATCACCAGGTGTAGT

CAGTCAGCCGGATTAGATACCCTAGTAGTC
```

Extraction and Purification Protocol

The DNA in the spiked soil samples was then extracted using the Qiagen DNeasy PowerSoil Kit™. The Agilent Bioanalyzer confirmed that samples contained amplicon products from both the soil microorganisms of the sample and the nucleic acid construct described herein, based on the different amplicon sizes: 16S (soil sample)=~600 bp and the nucleic acid construct=200 bp (FIGS. 2A and B).

Library Preparation and Sequencing Protocol

Figure 3A:
FIGS. 3A-C show the Krona plot of all soil bacteria present in the CCC-1 DNA-spiked sample (FIG. 3A), the CCC-2 DNA spiked sample (FIG. 3B), and the CCC-1 and CCC-2 DNA mixed spiked sample (FIG. 3C). The figures demonstrate that the spike-in controls do not interfere with the target (i.e., bacterial DNA) amplification or sequencing.
Figure 3B:
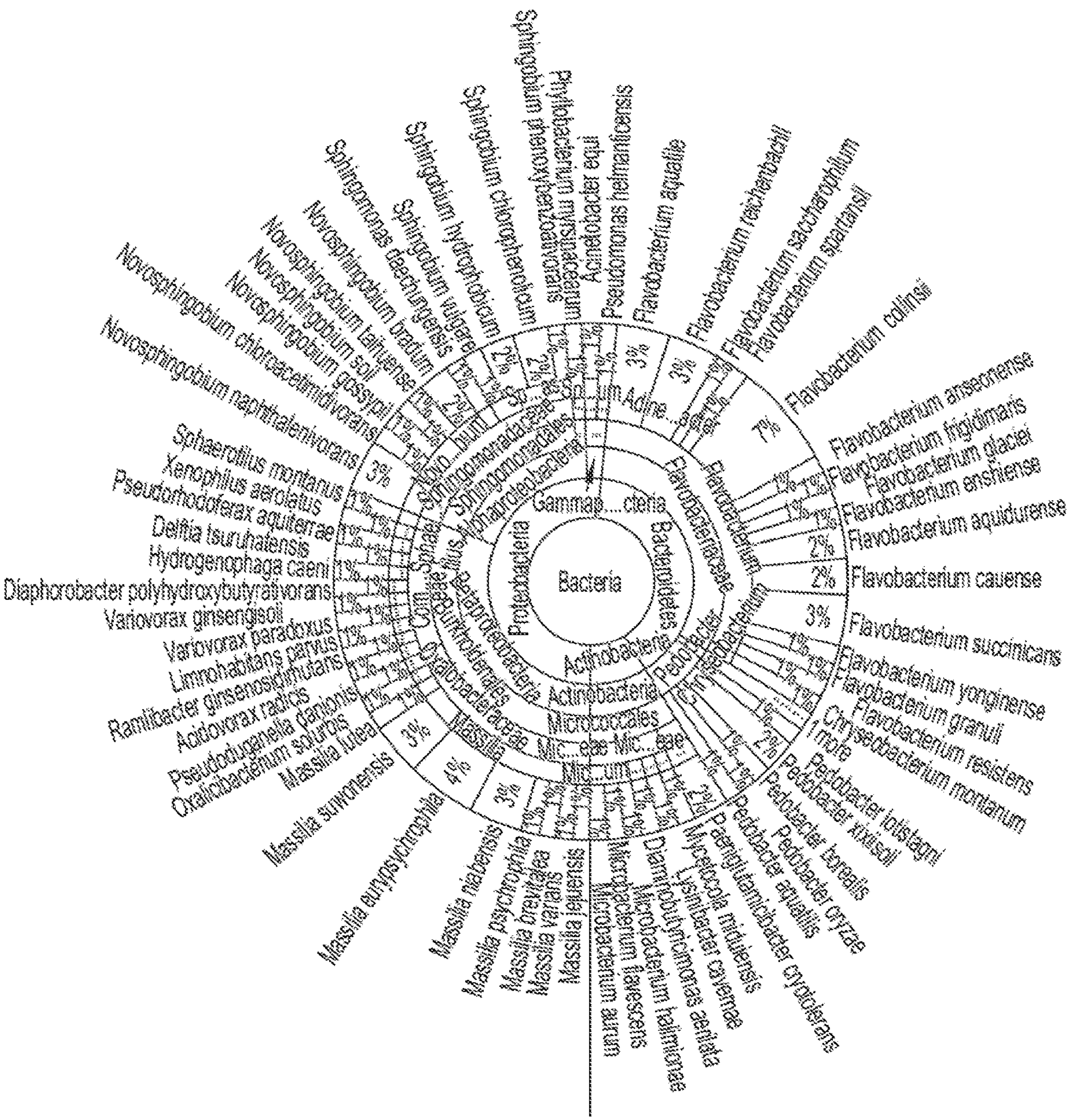
Figure 3C:
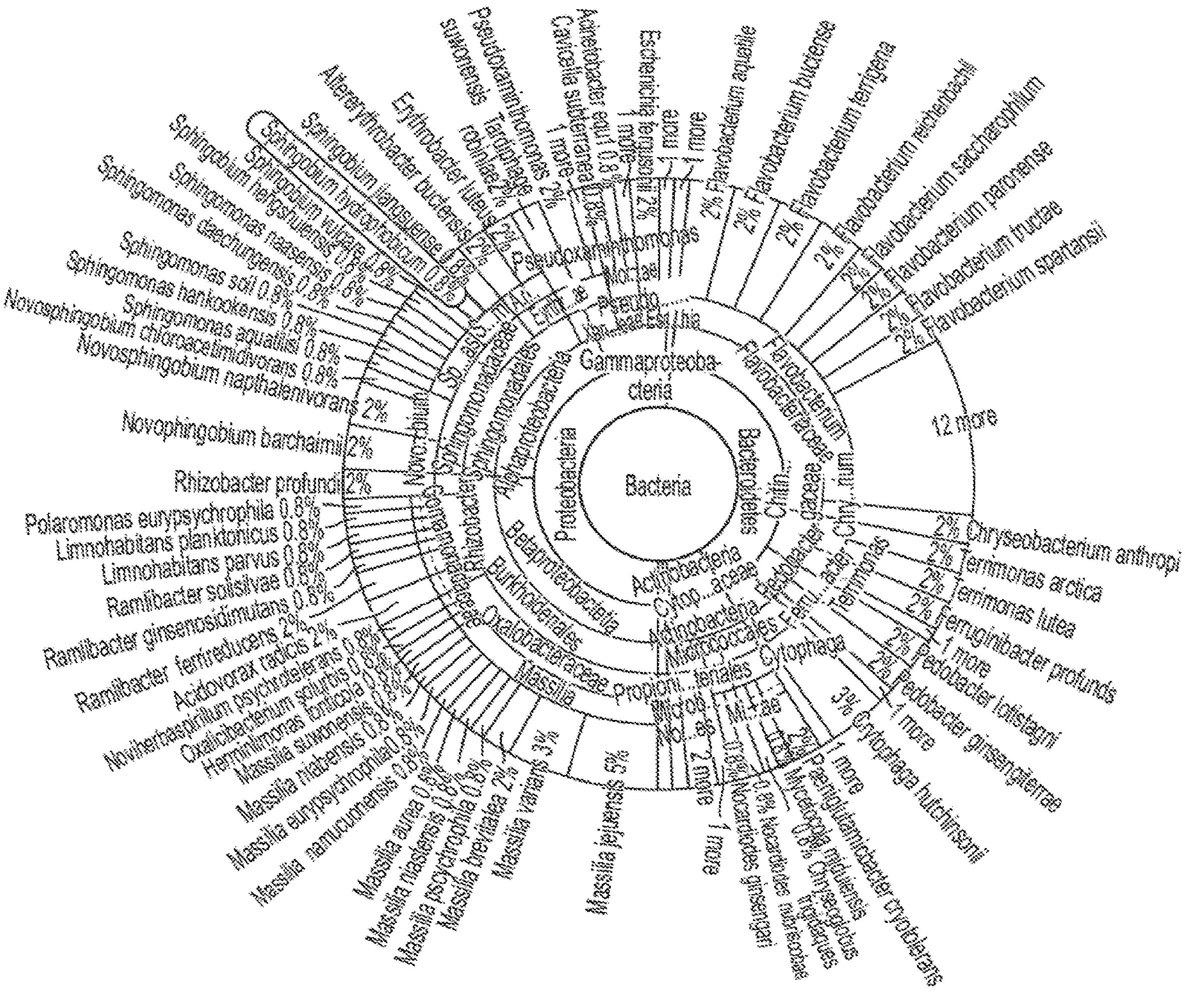

The 16S DNA was amplified and prepared for Illumina NGS sequencing on an Illumina MiSeq. The bead based clean-ups were replaced with MinElute PCR clean up columns. After library preparation, the libraries were visualized on the Agilent Bioanalyzer using the DNA High Sensitivity Assay to check the ampification and size. The libraries were then sequenced on an Illumina MiSeq 300 cycle nanoflow cell. The data was processed and sequencing results showed that the expected microorganisms (FIGS. 3A and B), and both nucleic acid constructs comprising barcode sequence fragments (within CCC-1 DNA and CCC-2 DNA; FIG. 4) were successfully sequenced and present in their specific samples.

Figure 2A:
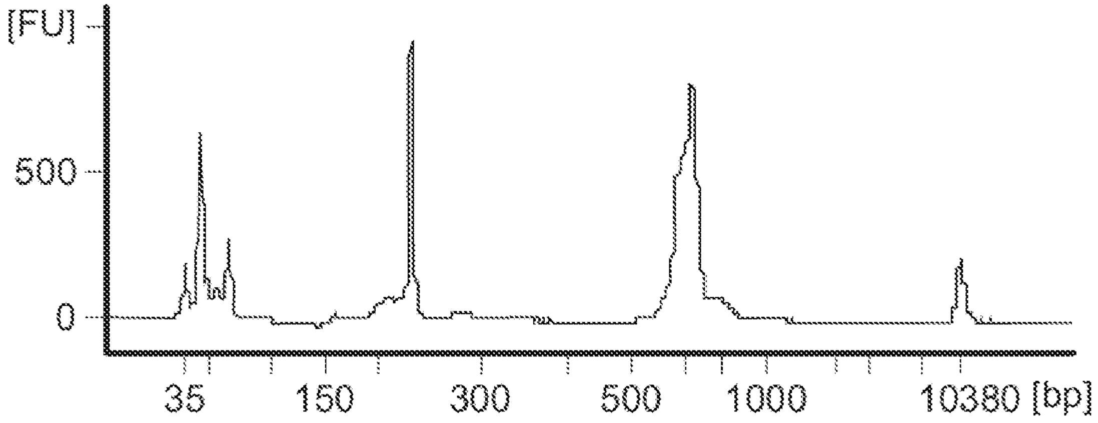
FIGS. 2A-B show the bioanalyzer results of CCC-1 DNA spike-in controls post soil extraction and library preparation (FIG. 2A) and the bioanalyzer results of CCC-1 DNA and CCC-2 DNA (for a description see Example 1) mixed spike-in controls post soil extraction and library preparation (FIG. 2B). Barcoded DNA peaks for the CCC-1 DNA and CCC-2 DNA controls can be seen at ~200 bp and 16S soil sample DNA libraries can be seen ~600 bp.
Figure 2B:
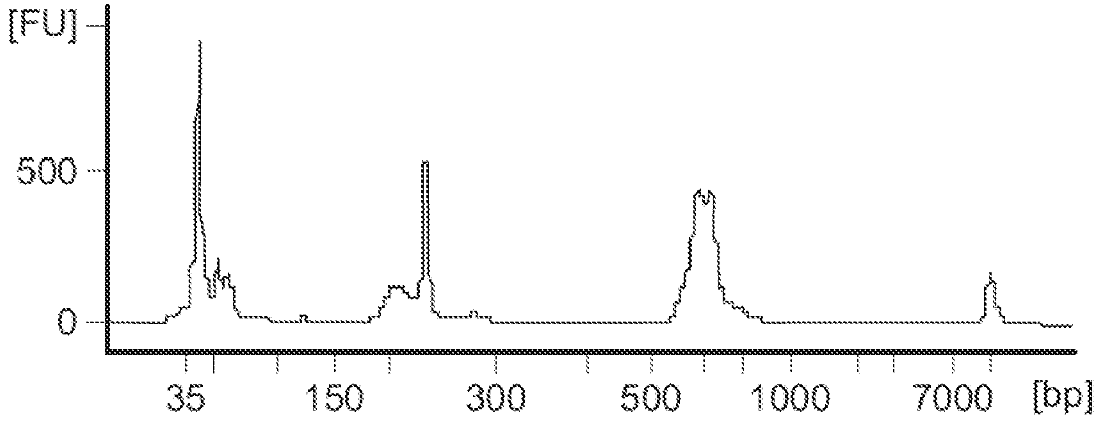

The data shown in FIGS. 2A and B, 3A, B, and C, and 4 are from soil sample DNA extraction assays where the spike-in protocol, the DNA extraction protocol, and the library preparation and sequencing protocols were performed according to the general protocols described above.

Example 2

Exemplary Scale-Up Encapsulation Protocol

Ethanol Injection Method

1. Solvent to be used is ethanol
2. Weigh lipids into 1 dram vials using Table 9 below. Target the mass in column 2 (at least). Record the actual mass in column 3. Calculate the volume of chloroform to add to each lipid as $V_{EtOH,Add}$ (mL)=$M_{Actual}$ (mg)/[(4*$M_{Target}$ (mg)/2 (mL)] and enter it in column 4 (stock volumes). The final result would be a 2 mL sample of a 10 mg/mL lipids solution with a 60:35:5 mole ratio of DPPC:Chol:PEG 2000.

TABLE 9

| Lipid Type | Target mass, $M_{Target}$ (mg) | Actual mass, $M_{Actual}$ (mg) | $V_{solvent,add}$ (mL) | $V_{stock,add}$ (mL) |
|---|---|---|---|---|
| DPPC | 12.4 | | | 0.5 |
| CHOL | 3.8 | | | 0.5 |
| PEG 2000 | 3.8 | | | 0.5 |
| LPS | 0 | | | 0 |
| EtOH | | | | 0.5 |

3. Dissolve lipids in the indicated volumes of ethanol. Then, to a 4 dram vial, add the volumes of each stock solution shown in column 5 of Table 2.
4. In a second 4 dram vial, add 2 mL of 20 mM Citrate buffer, pH 6.0.
5. Heat both to 45° C. in a water bath.
6. Draw both samples into separate 3 mL syringes and connect them to the t-connectors.
7. Using 2 syringe pumps, inject the two solutions into the t-connector a 1 mL/s (60 mL/hr). Collect the mixed solution in a stirred 4 dram vial containing 4 mL of 20 mM Citrate Buffer with 300 mM NaCl.
8. Incubate the resulting solution in a water bath at 37° C. for 30 minutes.
9. Separate the liposomes from free DNA by using sephadex columns.

Example 3

Protocol for Use of Control Compostions for Mass Spectrometry

Analytical chemistry analysis of unknown materials can be confounded by identification of compounds that do not seem to fit with what is expected. These unexpected compounds could be the result of a cross contamination event or may actually be present in the sample. Therefore, the next generation sequencing (NGS) cross contamination controls described herein were tested in a mass spectrometry protocol.

Chemical Sample Composition and Analysis

Mock chemical samples composed of 10 mL MilliQ water spiked with Cannabigerol at 10 ng/mL and Dicamba at 10 ng/mL were prepared for analysis. Two replicates (1A and 1B) were spiked with 20 μL (240 ng) of cross contamination control 1 (CCC1). Two replicates (2A and 2B) were spiked with 20 μL (240 ng) of cross contamination control 2 (CCC2), and two replicates (3A and 3B) were spiked with 20 μL (240 ng) of CCC1 and 20 μL (240 ng) of CCC2 for a total of six samples for analysis. A negative control blank of water was also prepared and tested. A positive control spiked with Cannabigerol at 10 ng/mL and Dicamba at 10 ng/mL in water was run concurrently with the mock contamination samples. Chemical analysis was performed on a Waters Xevo TQ-XS triple quadrupole mass spectrometer following standard analytical methods for both spiked compounds. The pertinent instrument conditions are shown in Table 10.

TABLE 10

| UPLC-MS/MS System Description | |
|---|---|
| UPLC | Waters Acquity |
| Tandem Mass Spectrometer | Waters Xevo TQ-S |
| Mass Spec Source | Electrospray, negative ion mode |
| Mass Spec Software | Waters MassLynx |

TABLE 10-continued

| UPLC-MS/MS System Description | |
|---|---|
| HPLC Column | Phenomenex Prodigy ODS-3 100 Å 3 μm 2 × 100 mm |
| HPLC Column Temperature | 50° C. |
| Mobile Phase Components | A = 0.1% Formic Acid in Milli-Q Water<br>B = 0.1% Formic Acid in Acetonitrile |

| | Time, min | % B | Flow rate, mL/min | Curve |
|---|---|---|---|---|
| Gradient Profile | 0 | 90 | 0.3 | — |
| | 1 | 90 | 0.3 | 2 |
| | 6 | 10 | 0.3 | 6 |
| | 6.1 | 0 | 0.3 | 6 |
| | 7.0 | 0 | 0.3 | 6 |
| | 7.01 | 90 | 0.4 | 6 |
| | 8 | 90 | 0.4 | 1 |

| | |
|---|---|
| Injection Volume | 5 μL |
| Capillary | 0.5 kV |
| Source Temperature | 110° C. |
| Desolvation, nebulizer gas | Nitrogen @ 1000 l/hr and 600° C. |
| Collision gas | Argon @ 0.15 mL/min |
| Mass Resolution | Unit in both quadrupoles |
| Run Time | Approximately 8 min |

| | Compound | Precursor | Cone (V) | Product | Collision (eV) |
|---|---|---|---|---|---|
| Ions | Cannabigerol | 317.2 | 30 | 69.2 | 20 |
| | | | | 95.2 | 20 |
| | Dicamba | 219 | 10 | 175 | 10 |
| | | | | 177 | 10 |

Nucleic Acid Extraction

Encapsulated DNA from the cross-contamination control spike-in mock chemical samples were captured using a 0.22 μM nylon membrane filter (Agilent, Cat. No. R000038111) within a filtration system. The cross-contamination controls were extracted from the nylon membranes using a DNeasy PowerWater Kit (Qiagen, 14900-50-NF) and the DNA was eluted in molecular biology grade water. One tenth of the filtrate volume of 3M sodium acetate pH 5.2 was added to each filtrate. Twice the volume of the filtrate volume of ethanol (Fisher; Cat. No. BP2818-500) was added and incubated overnight at −20° C. Each sample was centrifuged at 16,000×g for 20 minutes at 4° C. and the supernatant was discarded. The DNA pellet was washed with 10 mL of 70% ethanol and centrifuged at 16,000×g for 2 minutes. The alcohol was removed, and the nucleic acid pellet air dried in a BSC until visibly dry (~15-30 minutes). The DNA pellet was suspended using the 100 μL of PowerWater DNA sample prepared using the PowerWater Kit. The extracted DNA was cleaned using a OneStep PCR Inhibitor Removal Kit (Zymo Research; Cat. No. D6030).

Sequencing

The extracted DNA samples, and a non-encapsulated CCC-1 positive control, were amplified using a KAPA HiFi Hot Start Ready Mix (KAPA Biosystems; Cat. No. 07958935001) following the Illumina 16S Metagenomic Sequencing Library Preparation guideline. The thermocycler conditions were as follows: one cycle of 95° C. for 3 minutes, 25 cycles of 95° C. for 0.5 minutes, 55° C. for 0.5 minutes, and 72° C. for 0.5 minutes; and one cycle of 72° C. for 5 minutes. The following 16S rRNA gene-specific primers coupled to Illumina adapter overhang nucleotide sequences were used:

```
16S Forward Primer =
                                            (SEQ ID NO: 773)
5' TCGTCGGCAGCGTCAGATGTGTATAAGAGACAGCCTACGGGNGGCW

GCAG 3'

16S Reverse Primer =
                                            (SEQ ID NO: 774)
5' GTCTCGTGGGCTCGGAGATGTGTATAAGAGACAGGACTACHVGGGT

ATCTAATCC 3'
```

After amplification, the products were purified using a MinElute PCR Purification Kit (Qiagen; Cat. No. 28006) followed with a SPRISelect (Beckman Coulter; Cat. No. B23317) bead size selection (0.9× Beads). Nextera Dual-index adapters (Illumina; Cat. No. 15055293) were added to the PCR products through amplification with the KAPA HiFi Hot Start Ready Mix (KAPA Biosystems; Cat. No. 07958935001) with the following thermocycler conditions: one cycle of 95° C. for 3 minutes, 8 cycles of 95° C. for 0.5 minutes, 55° C. for 0.5 minutes, and 72° C. for 0.5 minutes; and one cycle of 72° C. for 5 minutes. The libraries were purified using a MinElute PCR Purification Kit (Qiagen; Cat. No. 28006) followed with a SPRISelect (Beckman Coulter; Cat. No. B23317) bead size selection (1.4× Beads). Libraries were quantified using a Qubit dsDNA High Sensitivity kit (Invitrogen; Cat. No. Q32854), analyzed on an Agilent High Sensitivity DNA chip (Agilent; Cat. No. 5067-4627) using a 2100 Bioanalyzer and pooled and normalized to 1 nM with 10 mM Tris-HCl (pH 8.5). Pooled library was denatured using 0.2N NaOH, neutralized with 200 mM Tris-HCl pH 7, diluted to 10 pM with hybridization buffer, and combined with 5% PhiX volume (10 pM). The denatured Phi-X and amplicon library pool was heat denatured at 96° C. before loading onto a 500 cycles MiSeq Nano Kit V2 (Cat. No. MS-103-1003) and was sequenced on an Illumina MiSeq instrument using the 250×250 bp paired-end reads.

Bioinformatics

Data files were downloaded and unzipped for analysis. Cutadapt was run to remove adapters prior to analysis. A Grep search was conducted to identify and count the custom control sequences in each file.

Results

Mock chemical samples containing Cannabigerol and Dicamba were analyzed on a Waters Xevo TQ-XS triple quadrupole mass spectrometer. The MilliQ water negative control came back blank on the MS and the chemical samples all matched the positive control showing there was no influence in the spectra from the presence of the cross-contamination controls (Table 11).

TABLE 11

Spectra results from the spiked chemical samples

| Sample | CBG Concentration (% Recovery) | Dicamba Concentration (% Recovery) |
|---|---|---|
| Blank | Not Detected | Not Detected |
| Positive Control | 8.4 ng/mL (−16.0%) | 8.3 ng/mL (−17.2%) |
| Blank | Not Detected | Not Detected |
| 1A | 14.7 ng/mL (+46.7%) | 8.9 ng/mL (−11.0%) |
| 1B | 15.4 ng/mL (+53.5%) | 8.7 ng/mL (−12.6%) |
| 2A | 12.5 ng/mL (+25.3%) | 10.7 ng/mL (+7.1%) |
| 2B | 9.2 ng/mL (−7.7%) | 10.2 ng/mL (+2.2%) |
| 3A | 9.2 ng/mL (−8.5%) | 11.0 ng/mL (+10.0%) |
| 3B | 17.5 ng/mL (+75.4%) | 11.1 ng/mL (+10.7%) |
| Blank | Not Detected | Not Detected |
| Positive Control | 11.6 ng/mL (+16.0%) | 11.7 ng/mL (+17.2%) |

Results showed acceptable variance at this concentration, which was specifically chosen to be at the lower detection limit of the mass spectrometer. There were no detectable interferences from the mock cross contamination compounds that would suppress or enhance chromatography, or otherwise influence result interpretation by an analyst.

Aliquots from each sample along with a control of CCC1 in water were prepared and sequenced. Adapter sequences, short and low-quality reads were removed prior to data analysis. The reads that passed quality control were counted for CCC1 or CCC2. The number of reads for each cross-contamination control are shown in Table 12.

TABLE 12

Read counts for each cross-contamination control

| Sample | # of CCC1 reads (%) | # of CCC2 reads |
|---|---|---|
| CCC1 | 10768 (99.5%) | 51 (0.4%) |
| 1A | 10502 (99.4%) | 67 (0.6%) |
| 1B | 1808 (99.7%) | 5 (0.2%) |
| 2A | 57 (1.0%) | 5457 (99.0%) |
| 2B | 23 (1.1%) | 1921 (98.8%) |
| 3A | 7559 (75.6%) | 2444 (24.4% |
| 3B | 6696 (74.1%) | 2343 (25.9%) |

The results show that the cross-contamination controls spiked into the chemical samples do not interfere with chemical analysis and the controls can be detected in analytical chemistry samples when the solvent is water.

SEQUENCE LISTING (2962 sequences)

SEQ ID NO: 1 - DNA, 77 bp, synthetic construct
  misc_feature 1..77: note = Description of Artificial Sequence: Synthetic oligonucleotide
  source 1..77: mol_type = other DNA
cctacgggaggcatcaggcagatctcgcctacgggaggcatcagagtcagtcagccggattagataccctagtagtc

SEQ ID NO: 2 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 3 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 4 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 5 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 6 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 7 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 8 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 9 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 10 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 11 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 12 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 13 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 14 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 15 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 16 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 17 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 18 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 19 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 20 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 21 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 22 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 23 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 24 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 25 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 26 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 27 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 28 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 29 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 30 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 31 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 32 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 33 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 34 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 35 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 36 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 37 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 38 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 39 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 40 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 41 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 42 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 43 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 44 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 45 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 46 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 47 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 48 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 49 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 50 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 51 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 52 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 53 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 54 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 55 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 56 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 57 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 58 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 59 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 60 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 61 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 62 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 63 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 64 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 65 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 66 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 67 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 68 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 69 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 70 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 71 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 72 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 73 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 74 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 75 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 76 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 77 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 78 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 79 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 80 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 81 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 82 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 83 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 84 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 85 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 86 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 87 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 88 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 89 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 90 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 91 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 92 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 93 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 94 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 95 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 96 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 97 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 98 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 99 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 100 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 101 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 102 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 103 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 104 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 105 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 106 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 107 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 108 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 109 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 110 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 111 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 112 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 113 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 114 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 115 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 116 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 117 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 118 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 119 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 120 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 121 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 122 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 123 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 124 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 125 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 126 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 127 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 128 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 129 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 130 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 131 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 132 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 133 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 134 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 135 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 136 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 137 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 138 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 139 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 140 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 141 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 142 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 143 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 144 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 145 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 146 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 147 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 148 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 149 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 150 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 151 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 152 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 153 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 154 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 155 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 156 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 157 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 158 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 159 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 160 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 161 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 162 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 163 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 164 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 165 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 166 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 167 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 168 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 169 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 170 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 171 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 172 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 173 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 174 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 175 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 176 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 177 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 178 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 179 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 180 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 181 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 182 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 183 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 184 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 185 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 186 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 187 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 188 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 189 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 190 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 191 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 192 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 193 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 194 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 195 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 196 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 197 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 198 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 199 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 200 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 201 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 202 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 203 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 204 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 205 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 206 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 207 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 208 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 209 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 210 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 211 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 212 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 213 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 214 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 215 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 216 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 217 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 218 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 219 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 220 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 221 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 222 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 223 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 224 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 225 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 226 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 227 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 228 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 229 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 230 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 231 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 232 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 233 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 234 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 235 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 236 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 237 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 238 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 239 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 240 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 241 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 242 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 243 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 244 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 245 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 246 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 247 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 248 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 249 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 250 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 251 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 252 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 253 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 254 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 255 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 256 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 257 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 258 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 259 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 260 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 261 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 262 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 263 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 264 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 265 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 266 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 267 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 268 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 269 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 270 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 271 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 272 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 273 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 274 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 275 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 276 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 277 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 278 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 279 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 280 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 281 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 282 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 283 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 284 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 285 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 286 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 287 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 288 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 289 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 290 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 291 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 292 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 293 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 294 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 295 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 296 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 297 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 298 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 299 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 300 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 301 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 302 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 303 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 304 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 305 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 306 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 307 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 308 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 309 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 310 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 311 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 312 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 313 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 314 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 315 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 316 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 317 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 318 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 319 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 320 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 321 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 322 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 323 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 324 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 325 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 326 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 327 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 328 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 329 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 330 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 331 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 332 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 333 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 334 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 335 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 336 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 337 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 338 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 339 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 340 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 341 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 342 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 343 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 344 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 345 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 346 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 347 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 348 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 349 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 350 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 351 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 352 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 353 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 354 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 355 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 356 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 357 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 358 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 359 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 360 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 361 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 362 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 363 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 364 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 365 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 366 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 367 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 368 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 369 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 370 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 371 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 372 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 373 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 374 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 375 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 376 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 377 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 378 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 379 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 380 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 381 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 382 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 383 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 384 - DNA, 77 bp, synthetic construct; identical to SEQ ID NO: 1
  misc_feature 1..77: note = Description of Artificial Sequence: Synthetic oligonucleotide
  source 1..77: mol_type = other DNA

SEQ ID NO: 385 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcccttgtctccacgagactgattagtcagtcagccggattagataccctagtagtc

SEQ ID NO: 386 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggctgtacggattatcaccaggtgtagtcagtcagccggattagataccctagtagtc

SEQ ID NO: 387 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtggtcaacgatacatcgcgttgacagtcagtcagccggattagataccctagtagtc

SEQ ID NO: 388 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatcgcacagtaagcacatagtcgtagtcagtcagccggattagataccctagtagtc

SEQ ID NO: 389 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtcgtgtagcctggcaaatacactagtcagtcagccggattagataccctagtagtc

SEQ ID NO: 390 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagcggaggttaggtcatgctccagagtcagtcagccggattagataccctagtagtc

SEQ ID NO: 391 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatcctttggttccctagtaagctgagtcagtcagccggattagataccctagtagtc

SEQ ID NO: 392 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtacagcgcatacttaccgacgagtagtcagtcagccggattagataccctagtagtc

SEQ ID NO: 393 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaccggtatgtacgcttagatgtagagtcagtcagccggattagataccctagtagtc

SEQ ID NO: 394 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaattgtgtcggaaagacgtagcggagtcagtcagccggattagataccctagtagtc

SEQ ID NO: 395 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgcatacactggttaccttacaccagtcagtcagccggattagataccctagtagtc

SEQ ID NO: 396 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagtcgaacgaggtgactaatggccagtcagtcagccggattagataccctagtagtc

SEQ ID NO: 397 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaccagtgactcactctctcacttgagtcagtcagccggattagataccctagtagtc

SEQ ID NO: 398 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggaataccaagtcattgcaagcaacagtcagtcagccggattagataccctagtagtc

SEQ ID NO: 399 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtagatcgtgtacacgtgacatgtagtcagtcagccggattagataccctagtagtc

SEQ ID NO: 400 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaacgtgtgtgccacagttgaagtagtcagtcagccggattagataccctagtagtc

SEQ ID NO: 401 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcattatggcgtgctaggatcactgagtcagtcagccggattagataccctagtagtc

SEQ ID NO: 402 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgccaatacgcctggatgacccaaatagtcagtcagccggattagataccctagtagtc

SEQ ID NO: 403 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatctgcgatccaccggagtaggaagtcagtcagccggattagataccctagtagtc

SEQ ID NO: 404 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcagctcatcagctgaggactacctagtcagtcagccggattagataccctagtagtc

SEQ ID NO: 405 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcaaacaacagctcaatcggcttgcagtcagtcagccggattagataccctagtagtc

SEQ ID NO: 406 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcaacaccatccaacactcgatcgagtcagtcagccggattagataccctagtagtc

SEQ ID NO: 407 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcgatatatcgctgaccggctgttagtcagtcagccggattagataccctagtagtc

SEQ ID NO: 408 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgagcaatcctaggaggagcaataagtcagtcagccggattagataccctagtagtc

SEQ ID NO: 409 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagtcgtgcacatagcgacgaagacagtcagtcagccggattagataccctagtagtc

SEQ ID NO: 410 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtatctgcgcgtcttccctaactcagtcagtcagccggattagataccctagtagtc

SEQ ID NO: 411 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgagggaaagtctggaagaacggcagtcagtcagccggattagataccctagtagtc

SEQ ID NO: 412 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcaaattcgggatgctagacactacagtcagtcagccggattagataccctagtagtc

SEQ ID NO: 413 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagattgaccaacttggattgaacgagtcagtcagccggattagataccctagtagtc

SEQ ID NO: 414 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagttacgagctagatataccagtgagtcagtcagccggattagataccctagtagtc

SEQ ID NO: 415 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcatatgcactgaacaaactgccaagtcagtcagccggattagataccctagtagtc

SEQ ID NO: 416 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcaactcccgtgagtagacatgtgtagtcagtcagccggattagataccctagtagtc

SEQ ID NO: 417 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttgcgttagcagtacagttacgcgagtcagtcagccggattagataccctagtagtc

SEQ ID NO: 418 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtacgagccctaacaagccctagtaagtcagtcagccggattagataccctagtagtc

SEQ ID NO: 419 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcactacgctagatagtgtcggatcagtcagtcagccggattagataccctagtagtc

SEQ ID NO: 420 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgcagtcctcgactgagctctgcaagtcagtcagccggattagataccctagtagtc

SEQ ID NO: 421 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaccatagctccgcttcgactttccagtcagtcagccggattagataccctagtagtc

SEQ ID NO: 422 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcgacatctcttgtcataagaaccagtcagtcagccggattagataccctagtagtc

SEQ ID NO: 423 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggaacactttggagtccgcaagttaagtcagtcagccggattagataccctagtagtc

SEQ ID NO: 424 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggagccatctgtacgtagagctctcagtcagtcagccggattagataccctagtagtc

SEQ ID NO: 425 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttgggtacacgtcctctgagagctagtcagtcagccggattagataccctagtagtc

SEQ ID NO: 426 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaaggcgctccttcctcgatgcagtagtcagtcagccggattagataccctagtagtc

SEQ ID NO: 427 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaatacggatcggcggactattcaagtcagtcagccggattagataccctagtagtc

SEQ ID NO: 428 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcggaattagaccgtgcacaattgagtcagtcagccggattagataccctagtagtc

SEQ ID NO: 429 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtgaattcggacggcctaagttcagtcagtcagccggattagataccctagtagtc

SEQ ID NO: 430 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcattcgtggcgtagcgctcacatcagtcagtcagccggattagataccctagtagtc

SEQ ID NO: 431 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtactacgtggcctggttatggcacagtcagtcagccggattagataccctagtagtc

SEQ ID NO: 432 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggccagttcctacgaggttctgatagtcagtcagccggattagataccctagtagtc

SEQ ID NO: 433 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatgttcgctagaactcctgtggaagtcagtcagccggattagataccctagtagtc

SEQ ID NO: 434 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctatctcctgtctaatggtcgtagagtcagtcagccggattagataccctagtagtc

SEQ ID NO: 435 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgactcacaggaatttgcaccgtcgaagtcagtcagccggattagataccctagtagtc

SEQ ID NO: 436 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatgatgagcctctgctacagacgtagtcagtcagccggattagataccctagtagtc

SEQ ID NO: 437 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtcgacagaggaatggcctgactaagtcagtcagccggattagataccctagtagtc

SEQ ID NO: 438 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtcgcaaatagacgcacatacaaagtcagtcagccggattagataccctagtagtc

SEQ ID NO: 439 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcatccctctacttgagtggtctgtagtcagtcagccggattagataccctagtagtc

SEQ ID NO: 440 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtataccgctgcggatagcactcgtagtcagtcagccggattagataccctagtagtc

SEQ ID NO: 441 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagttgaggcatttagcgcgaacttagtcagtcagccggattagataccctagtagtc

SEQ ID NO: 442 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacaatagacacccatacacgcaccagtcagtcagccggattagataccctagtagtc

SEQ ID NO: 443 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcggtcaattgacacctcagtcaagagtcagtcagccggattagataccctagtagtc

SEQ ID NO: 444 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtggagtctcattcgaccaaacacagtcagtcagccggattagataccctagtagtc

SEQ ID NO: 445 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggctcgaagattcccacccagtaacagtcagtcagccggattagataccctagtagtc

SEQ ID NO: 446 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaggcttacgtgtatatcgcgatgaagtcagtcagccggattagataccctagtagtc

SEQ ID NO: 447 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtctctaccactccgccggtaatctagtcagtcagccggattagataccctagtagtc

SEQ ID NO: 448 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacttccaacttcccgatgccttgaagtcagtcagccggattagataccctagtagtc

SEQ ID NO: 449 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctcacctaggaaagcaggcacgaaagtcagtcagccggattagataccctagtagtc

SEQ ID NO: 450 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtgttgtcgtgctacgcagcactaagtcagtcagccggattagataccctagtagtc

SEQ ID NO: 451 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgccacagatcgatcgcttagtgctgagtcagtcagccggattagataccctagtagtc

SEQ ID NO: 452 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtatcgacacaagcaaagtttgcgaagtcagtcagccggattagataccctagtagtc

SEQ ID NO: 453 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggattccggctcatcgagccgatctagtcagtcagccggattagataccctagtagtc

SEQ ID NO: 454 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgtaattgccgcctcatcatgttcagtcagtcagccggattagataccctagtagtc

SEQ ID NO: 455 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggtgactagttcccagggacttctagtcagtcagccggattagataccctagtagtc

SEQ ID NO: 456 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatgggttccgtcgcaatccttgcgagtcagtcagccggattagataccctagtagtc

SEQ ID NO: 457 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaggcatgcttgcctgcttccttcagtcagtcagccggattagataccctagtagtc

SEQ ID NO: 458 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaactagttcaggcaaggcacaaggagtcagtcagccggattagataccctagtagtc

SEQ ID NO: 459 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgattctgccgaagggcctataagtcagtcagtcagccggattagataccctagtagtc

SEQ ID NO: 460 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagcatgtcccgttccatttcatgcagtcagtcagccggattagataccctagtagtc

SEQ ID NO: 461 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtacgatatgactcggcgatcatcagtcagtcagccggattagataccctagtagtc

SEQ ID NO: 462 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtggtggtttccgtttcacgcgaaagtcagtcagccggattagataccctagtagtc

SEQ ID NO: 463 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtagtatgcgcaaacaagaaccttgagtcagtcagccggattagataccctagtagtc

SEQ ID NO: 464 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgcgctgaatgttactctcttagcagtcagtcagccggattagataccctagtagtc

SEQ ID NO: 465 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatggctgtcagtaactgttcgcgcagtcagtcagccggattagataccctagtagtc

SEQ ID NO: 466 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggttctcttctcgcgaagcatctacagtcagtcagccggattagataccctagtagtc

SEQ ID NO: 467 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgtaagatgcctgtttggccacacagtcagtcagccggattagataccctagtagtc

SEQ ID NO: 468 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcgttctagctgtcaggttgcccaagtcagtcagccggattagataccctagtagtc

SEQ ID NO: 469 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggttgttctgggatcattccactcaagtcagtcagccggattagataccctagtagtc

SEQ ID NO: 470 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggacttccagctgtcacatcacgaagtcagtcagccggattagataccctagtagtc

SEQ ID NO: 471 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctcacaaccgtgcgacatttctctagtcagtcagccggattagataccctagtagtc

SEQ ID NO: 472 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctgctattcctcggacgttaactaagtcagtcagccggattagataccctagtagtc

SEQ ID NO: 473 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatgtcaccgctgtagcagttgcgtagtcagtcagccggattagataccctagtagtc

SEQ ID NO: 474 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtaacgccgatcacgctattggaagtcagtcagccggattagataccctagtagtc

SEQ ID NO: 475 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagcagaacatctaacttcacttccagtcagtcagccggattagataccctagtagtc

SEQ ID NO: 476 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtggagtaggtggccagtggatataagtcagtcagccggattagataccctagtagtc

SEQ ID NO: 477 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttggctctattctgtgtgtaacgcagtcagtcagccggattagataccctagtagtc

SEQ ID NO: 478 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatcccacgtacccaatcgtgcaaagtcagtcagccggattagataccctagtagtc

SEQ ID NO: 479 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaccgcttcttcaggctagcagagagtcagtcagccggattagataccctagtagtc

SEQ ID NO: 480 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtgcgataacagtcactccgaacagtcagtcagccggattagataccctagtagtc

SEQ ID NO: 481 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggattatcgacgacaccgaaatctgagtcagtcagccggattagataccctagtagtc

SEQ ID NO: 482 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcctagcccaattgacgtagaactagtcagtcagccggattagataccctagtagtc

SEQ ID NO: 483 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatgtatgtggtctatgccggctaagtcagtcagccggattagataccctagtagtc

SEQ ID NO: 484 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgactccttgtgttgtggtatgggagagtcagtcagccggattagataccctagtagtc

SEQ ID NO: 485 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtcacggacatttgtaccaaccgaagtcagtcagccggattagataccctagtagtc

SEQ ID NO: 486 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcgagcgaagtaagggtacagggtagtcagtcagccggattagataccctagtagtc

SEQ ID NO: 487 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatctaccgaagcagagtgctaatcagtcagtcagccggattagataccctagtagtc

SEQ ID NO: 488 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacttggtgtaagttggcgggttatagtcagtcagccggattagataccctagtagtc

SEQ ID NO: 489 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcttggaggtcacacgatggtcatagtcagtcagccggattagataccctagtagtc

SEQ ID NO: 490 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcacctccttgtgtcaccaatccgagtcagtcagccggattagataccctagtagtc

SEQ ID NO: 491 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcacacctgatacactaacaaacgagtcagtcagccggattagataccctagtagtc

SEQ ID NO: 492 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcgacaattacattccaggcagatagtcagtcagccggattagataccctagtagtc

SEQ ID NO: 493 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcatgctccatttatggtacccagagtcagtcagccggattagataccctagtagtc

SEQ ID NO: 494 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagctgtcaagctcacgacttgacaagtcagtcagccggattagataccctagtagtc

SEQ ID NO: 495 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggagagcaacagacttggaggcttaagtcagtcagccggattagataccctagtagtc

SEQ ID NO: 496 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtactcgggaactacgtggttccacagtcagtcagccggattagataccctagtagtc

SEQ ID NO: 497 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgtgcttaggctgacgctttgctgagtcagtcagccggattagataccctagtagtc

SEQ ID NO: 498 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaccgaaggtatacagggtttgtaagtcagtcagccggattagataccctagtagtc

SEQ ID NO: 499 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcactcatcattcgcctatgagatcagtcagtcagccggattagataccctagtagtc

SEQ ID NO: 500 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtatttcggacgcaaacctatggcagtcagtcagccggattagataccctagtagtc

SEQ ID NO: 501 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtatctatcctgcatcgcttaaggcagtcagtcagccggattagataccctagtagtc

SEQ ID NO: 502 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttgccaagagtcaccatccaacgaagtcagtcagccggattagataccctagtagtc

SEQ ID NO: 503 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagtagcggaagagcaataggaggaagtcagtcagccggattagataccctagtagtc

SEQ ID NO: 504 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcaattaggtacccgaacgtcactagtcagtcagccggattagataccctagtagtc

SEQ ID NO: 505 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcataccgtgagtacaccaacaccaagtcagtcagccggattagataccctagtagtc

SEQ ID NO: 506 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatgtgtgtagacccatcacataggagtcagtcagccggattagataccctagtagtc

SEQ ID NO: 507 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcctgcgaagtatcgacacggagaaagtcagtcagccggattagataccctagtagtc

SEQ ID NO: 508 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttctctcgacatgaacctatgacaagtcagtcagccggattagataccctagtagtc

SEQ ID NO: 509 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggctctccgtagaatgccggtaataagtcagtcagccggattagataccctagtagtc

SEQ ID NO: 510 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggttaagctgaccgaacagctctacagtcagtcagccggattagataccctagtagtc

SEQ ID NO: 511 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatgccatgccgtgtgagtcataccagtcagtcagccggattagataccctagtagtc

SEQ ID NO: 512 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggacattgtcacgtggccgttactgagtcagtcagccggattagataccctagtagtc

SEQ ID NO: 513 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggccaacaaccattagagctgccatagtcagtcagccggattagataccctagtagtc

SEQ ID NO: 514 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatcagtactaggatctagtggcaaagtcagtcagccggattagataccctagtagtc

SEQ ID NO: 515 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcctcgagcgatccttcaatgggaagtcagtcagccggattagataccctagtagtc

SEQ ID NO: 516 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacccaagcgttattgacgacatcgagtcagtcagccggattagataccctagtagtc

SEQ ID NO: 517 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgcagcaagattacatactgagcaagtcagtcagccggattagataccctagtagtc

SEQ ID NO: 518 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagcaacattgcaggctaaactatgagtcagtcagccggattagataccctagtagtc

SEQ ID NO: 519 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatgtggtgttaaagagcagagccagtcagtcagccggattagataccctagtagtc

SEQ ID NO: 520 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcagaaatgtgtcggagagatcacgagtcagtcagccggattagataccctagtagtc

SEQ ID NO: 521 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtagaggtagagtcaacccgtgaaagtcagtcagccggattagataccctagtagtc

SEQ ID NO: 522 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgtgatccgctagtttgaaacacgagtcagtcagccggattagataccctagtagtc

SEQ ID NO: 523 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggttatttggcgagagagacaggtagtcagtcagccggattagataccctagtagtc

SEQ ID NO: 524 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggatcgtaatactcgccagtgcatagtcagtcagccggattagataccctagtagtc

SEQ ID NO: 525 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcatagcatcaagctcaggactctagtcagtcagccggattagataccctagtagtc

SEQ ID NO: 526 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtgttagatgtgcactttgggtgcagtcagtcagccggattagataccctagtagtc

SEQ ID NO: 527 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttagagccatgctctagcctggcaagtcagtcagccggattagataccctagtagtc

SEQ ID NO: 528 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgaaccctatggaatgcaatgcgtagtcagtcagccggattagataccctagtagtc

SEQ ID NO: 529 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagagtcttgccacgaatgagtcatagtcagtcagccggattagataccctagtagtc

SEQ ID NO: 530 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacaacactccgacaacgctagaatagtcagtcagccggattagataccctagtagtc

SEQ ID NO: 531 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgatgctgttgaatcagagcccatagtcagtcagccggattagataccctagtagtc

SEQ ID NO: 532 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacgactgcataatctgtagagccaagtcagtcagccggattagataccctagtagtc

SEQ ID NO: 533 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacgcgaactaatccgactctaggtagtcagtcagccggattagataccctagtagtc

SEQ ID NO: 534 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagctatgtatggatcctacgagcaagtcagtcagccggattagataccctagtagtc

SEQ ID NO: 535 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacgggtcatcatgacaacgaatctagtcagtcagccggattagataccctagtagtc

SEQ ID NO: 536 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggaaacatcccactgcggttgactcagtcagtcagccggattagataccctagtagtc

SEQ ID NO: 537 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgtactctcgagtgagaagaaaggagtcagtcagccggattagataccctagtagtc

SEQ ID NO: 538 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcagttctcgtttcggatctgtgaagtcagtcagccggattagataccctagtagtc

SEQ ID NO: 539 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcgtgcgtgttggccggtactctaagtcagtcagccggattagataccctagtagtc

SEQ ID NO: 540 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggttatcgcatggcacaggattaccagtcagtcagccggattagataccctagtagtc

SEQ ID NO: 541 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatcacgagaggcgatatcagtagagtcagtcagccggattagataccctagtagtc

SEQ ID NO: 542 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtaaattcaggccataagggaggcagtcagtcagccggattagataccctagtagtc

SEQ ID NO: 543 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagtgtttcggactgtgttactcctagtcagtcagccggattagataccctagtagtc

SEQ ID NO: 544 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacacgcggtttaggtacctgcaatagtcagtcagccggattagataccctagtagtc

SEQ ID NO: 545 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtggcaaatctagtcgcctataaggagtcagtcagccggattagataccctagtagtc

SEQ ID NO: 546 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcaccttaccttaagtggcactatcagtcagtcagccggattagataccctagtagtc

SEQ ID NO: 547 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttaaccttcctgtaacccgatagaagtcagtcagccggattagataccctagtagtc

SEQ ID NO: 548 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgccgtatgccagtgtgctaacgtagtcagtcagccggattagataccctagtagtc

SEQ ID NO: 549 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgtgacaatagtcttgcggcaatcagtcagtcagccggattagataccctagtagtc

SEQ ID NO: 550 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgctacaactcgtgaggtttgatgagtcagtcagccggattagataccctagtagtc

SEQ ID NO: 551 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttaagacagtcgattgctggtcgaagtcagtcagccggattagataccctagtagtc

SEQ ID NO: 552 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtctgcactgagcaagaagccggacagtcagtcagccggattagataccctagtagtc

SEQ ID NO: 553 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgcagattagtaacgggatacaggagtcagtcagccggattagataccctagtagtc

SEQ ID NO: 554 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgggtcccacataagagtctctagagtcagtcagccggattagataccctagtagtc

SEQ ID NO: 555 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcactggtgcatatccgtcatgggtagtcagtcagccggattagataccctagtagtc

SEQ ID NO: 556 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaacgtaggctctagatctatgcagagtcagtcagccggattagataccctagtagtc

SEQ ID NO: 557 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagttgtagtccggcacaaggcaagagtcagtcagccggattagataccctagtagtc

SEQ ID NO: 558 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcgtcaaacccgcggcaaacacttagtcagtcagccggattagataccctagtagtc

SEQ ID NO: 559 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaatcggtgccagcgagttcctgtagtcagtcagccggattagataccctagtagtc

SEQ ID NO: 560 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttgatccggtagttccgaatcggcagtcagtcagccggattagataccctagtagtc

SEQ ID NO: 561 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgggtgtttgcttacctagtgagaagtcagtcagccggattagataccctagtagtc

SEQ ID NO: 562 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttgaccgcggttcgttctggtggtagtcagtcagccggattagataccctagtagtc

SEQ ID NO: 563 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtgcaaccaatcttggtctcctctagtcagtcagccggattagataccctagtagtc

SEQ ID NO: 564 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcttgagcttgactgcatactgagagtcagtcagccggattagataccctagtagtc

SEQ ID NO: 565 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgctgtggattacagggcctttgtagtcagtcagccggattagataccctagtagtc

SEQ ID NO: 566 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctgtcagtgacccgatgaatatcgagtcagtcagccggattagataccctagtagtc

SEQ ID NO: 567 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacgattcgagtcgtcaattagtggagtcagtcagccggattagataccctagtagtc

SEQ ID NO: 568 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggttcggtccatagtacgcagtctagtcagtcagccggattagataccctagtagtc

SEQ ID NO: 569 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctgatccatcttagcagctattgcagtcagtcagccggattagataccctagtagtc

SEQ ID NO: 570 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtatgtgccggctctcggatagatcagtcagtcagccggattagataccctagtagtc

SEQ ID NO: 571 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtggtcgcatcgtttcccgaaacgaagtcagtcagccggattagataccctagtagtc

SEQ ID NO: 572 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtaagacttgggaactttagcgcagtcagtcagccggattagataccctagtagtc

SEQ ID NO: 573 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcggatctagtgttccttagaaggcagtcagtcagccggattagataccctagtagtc

SEQ ID NO: 574 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgatcttcgagcgatggacttcaaagtcagtcagccggattagataccctagtagtc

SEQ ID NO: 575 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtcgaatttgcgtactgagcctcgagtcagtcagccggattagataccctagtagtc

SEQ ID NO: 576 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcatcagagttaagaaggccttatagtcagtcagccggattagataccctagtagtc

SEQ ID NO: 577 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtggtcatcgtatggagccttgtcagtcagtcagccggattagataccctagtagtc

SEQ ID NO: 578 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctgaagggcgaactcgatgtaagcagtcagtcagccggattagataccctagtagtc

SEQ ID NO: 579 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgctcacagaatagcttcgacagtagtcagtcagccggattagataccctagtagtc

SEQ ID NO: 580 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgattcggtagtgcatacgcatcaagagtcagtcagccggattagataccctagtagtc

SEQ ID NO: 581 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgagctgttaccagatgtccgtcaagtcagtcagccggattagataccctagtagtc

SEQ ID NO: 582 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcaacacatgctggcacctgttgaaagtcagtcagccggattagataccctagtagtc

SEQ ID NO: 583 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgattctctcacgtcctagagaaactagtcagtcagccggattagataccctagtagtc

SEQ ID NO: 584 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgactctaaacggaggttcttgacagtcagtcagccggattagataccctagtagtc

SEQ ID NO: 585 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtcttcagcaagctgtaaaggttgagtcagtcagccggattagataccctagtagtc

SEQ ID NO: 586 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcggataacctcctgagtcattgagagtcagtcagccggattagataccctagtagtc

SEQ ID NO: 587 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagggtgactttatacggcagttcaagtcagtcagccggattagataccctagtagtc

SEQ ID NO: 588 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggacttcatgcgactctagaagagtagtcagtcagccggattagataccctagtagtc

SEQ ID NO: 589 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcctgtctgcaatgcacagtcgctagtcagtcagccggattagataccctagtagtc

SEQ ID NO: 590 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgactgatggcctccatgcggatcctagtcagtcagccggattagataccctagtagtc

SEQ ID NO: 591 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttcgatgccgcatgctccgtagaaagtcagtcagccggattagataccctagtagtc

SEQ ID NO: 592 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtggctcgtgttgataggtacacagtcagtcagccggattagataccctagtagtc

SEQ ID NO: 593 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaactttcaggagcgagttcatcgaagtcagtcagccggattagataccctagtagtc

SEQ ID NO: 594 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgcacgtgataaaagcagattgtcagtcagtcagccggattagataccctagtagtc

SEQ ID NO: 595 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggttcggtgtccatagaggcgtaggagtcagtcagccggattagataccctagtagtc

SEQ ID NO: 596 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaagacagctatctcagcgccgttaagtcagtcagccggattagataccctagtagtc

SEQ ID NO: 597 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgattgaccggtcatagaccgactccagtcagtcagccggattagataccctagtagtc

SEQ ID NO: 598 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttctccatcacagtcaacgctgtcagtcagtcagccggattagataccctagtagtc

SEQ ID NO: 599 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgtaggtagaggacaggagggtgtagtcagtcagccggattagataccctagtagtc

SEQ ID NO: 600 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatttaggacgacgctgtcgtcaacagtcagtcagccggattagataccctagtagtc

SEQ ID NO: 601 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggatagccaaggatagaggccattagtcagtcagccggattagataccctagtagtc

SEQ ID NO: 602 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtggttggttacgaagcttgaaaccagtcagtcagccggattagataccctagtagtc

SEQ ID NO: 603 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtcgtccaaatgtaagcgtctcgaagtcagtcagccggattagataccctagtagtc

SEQ ID NO: 604 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcaacgtgctccaatagcttcgtggagtcagtcagccggattagataccctagtagtc

SEQ ID NO: 605 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtacacaagtcgccgggatcaaattagtcagtcagccggattagataccctagtagtc

SEQ ID NO: 606 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcgtccatgaatagtcatcgaatgagtcagtcagccggattagataccctagtagtc

SEQ ID NO: 607 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtaatgcgtaacatcttggagtcgagtcagtcagccggattagataccctagtagtc

SEQ ID NO: 608 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtcgccgtacatagcaccggtcttagtcagtcagccggattagataccctagtagtc

SEQ ID NO: 609 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggaatccgattagcaaatcagcctagtcagtcagccggattagataccctagtagtc

SEQ ID NO: 610 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcacccgatggttgcaagctgtctcagtcagtcagccggattagataccctagtagtc

SEQ ID NO: 611 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttctgagaggtaagcggcctattaagtcagtcagccggattagataccctagtagtc

SEQ ID NO: 612 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatccctacggaatcttcaactaccagtcagtcagccggattagataccctagtagtc

SEQ ID NO: 613 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggttccattaggtggaattcggctagtcagtcagccggattagataccctagtagtc

SEQ ID NO: 614 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtgttcccagaataagatgcagtcagtcagtcagccggattagataccctagtagtc

SEQ ID NO: 615 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgccgaggtataattgccgagtaatcagtcagtcagccggattagataccctagtagtc

SEQ ID NO: 616 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagcgtaattagcaccttgacaagaagtcagtcagccggattagataccctagtagtc

SEQ ID NO: 617 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctcgtgaatgacgtaaccaccaccagtcagtcagccggattagataccctagtagtc

SEQ ID NO: 618 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaggtgagttctacatagctcggtcagtcagtcagccggattagataccctagtagtc

SEQ ID NO: 619 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcctgtcctatctaaccatgccaacagtcagtcagccggattagataccctagtagtc

SEQ ID NO: 620 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggtttaacacgctatggagctagtagtcagtcagccggattagataccctagtagtc

SEQ ID NO: 621 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagacagtaggagactacctcttcaagtcagtcagccggattagataccctagtagtc

SEQ ID NO: 622 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggccacgacttacgatgataacccaagtcagtcagccggattagataccctagtagtc

SEQ ID NO: 623 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgattgttcctaccggcccaatataaagtcagtcagccggattagataccctagtagtc

SEQ ID NO: 624 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggccgtaaacttgttgtatgacaggagtcagtcagccggattagataccctagtagtc

SEQ ID NO: 625 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcagatttccagggtaagtttgacagtcagtcagccggattagataccctagtagtc

SEQ ID NO: 626 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagatgatcagtcctaccacggtacagtcagtcagccggattagataccctagtagtc

SEQ ID NO: 627 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggagacgtgttctcggtctgtctgaagtcagtcagccggattagataccctagtagtc

SEQ ID NO: 628 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtatcaccggcacgtacatgtcgccagtcagtcagccggattagataccctagtagtc

SEQ ID NO: 629 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtatgccagagatttctagagtgcgagtcagtcagccggattagataccctagtagtc

SEQ ID NO: 630 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaggtccaaatcaacggatgttatgagtcagtcagccggattagataccctagtagtc

SEQ ID NO: 631 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaccgtgctcacattgaggctacaaagtcagtcagccggattagataccctagtagtc

SEQ ID NO: 632 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctccctttgtgtgtaggaaccggaagtcagtcagccggattagataccctagtagtc

SEQ ID NO: 633 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagctgcacctaaacatctagcagaagtcagtcagccggattagataccctagtagtc

SEQ ID NO: 634 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgccttgaccgatgccgacattgtagagtcagtcagccggattagataccctagtagtc

SEQ ID NO: 635 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctatcatcctcacatgtaaggctcagtcagtcagccggattagataccctagtagtc

SEQ ID NO: 636 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgactctagccggttgcaagctaagtagtcagtcagccggattagataccctagtagtc

SEQ ID NO: 637 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgataggccttagtgtgtgccataagtcagtcagccggattagataccctagtagtc

SEQ ID NO: 638 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaatgacctcgtgtgacaaccgaatagtcagtcagccggattagataccctagtagtc

SEQ ID NO: 639 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcttaggcatgtgtaggctcgtgctagtcagtcagccggattagataccctagtagtc

SEQ ID NO: 640 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgccagatatagcactccttaaggcgagtcagtcagccggattagataccctagtagtc

SEQ ID NO: 641 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggagagtccacttttgcctgggtcaagtcagtcagccggattagataccctagtagtc

SEQ ID NO: 642 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggaacgggacgtacaattctgcttcagtcagtcagccggattagataccctagtagtc

SEQ ID NO: 643 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacgtgtaggcttactggcaaacctagtcagtcagccggattagataccctagtagtc

SEQ ID NO: 644 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggtctcctacagaatcagagcttgagtcagtcagccggattagataccctagtagtc

SEQ ID NO: 645 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgactgacttaaggcaatgtagacacagtcagtcagccggattagataccctagtagtc

SEQ ID NO: 646 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatgctgccgtttggcgatacgttagtcagtcagccggattagataccctagtagtc

SEQ ID NO: 647 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttcctaggccaggccttacgatagagtcagtcagccggattagataccctagtagtc

SEQ ID NO: 648 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgattaagcctggatacctgtgtcttagtcagtcagccggattagataccctagtagtc

SEQ ID NO: 649 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtggctttctatcaacgaggcaacgagtcagtcagccggattagataccctagtagtc

SEQ ID NO: 650 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacagctcaaacagaagacagcgacagtcagtcagccggattagataccctagtagtc

SEQ ID NO: 651 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggagcgtatccatacacctgcgatcagtcagtcagccggattagataccctagtagtc

SEQ ID NO: 652 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatgggcgaatggggcgttgcattcagtcagtcagccggattagataccctagtagtc

SEQ ID NO: 653 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatctctgggtaactagcgttcagagtcagtcagccggattagataccctagtagtc

SEQ ID NO: 654 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcatcatacgggtttgcgacaaagtagtcagtcagccggattagataccctagtagtc

SEQ ID NO: 655 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtacggattatggtgcgagtatatgagtcagtcagccggattagataccctagtagtc

SEQ ID NO: 656 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatagcgaactcataccacaacgaaagtcagtcagccggattagataccctagtagtc

SEQ ID NO: 657 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaacgctgtgtgtctggaacggttagtcagtcagccggattagataccctagtagtc

SEQ ID NO: 658 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaaccaaactcgagtactacctcggagtcagtcagccggattagataccctagtagtc

SEQ ID NO: 659 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggccgtctcgtaattcctgttaaccagtcagtcagccggattagataccctagtagtc

SEQ ID NO: 660 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctgggtatctcgctatccaagtggagtcagtcagccggattagataccctagtagtc

SEQ ID NO: 661 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggactacccgttgcagtctagtacgagtcagtcagccggattagataccctagtagtc

SEQ ID NO: 662 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcgttgcaaactgtgtccggattcagtcagtcagccggattagataccctagtagtc

SEQ ID NO: 663 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaaccgcataagttgtggtgatgtaagtcagtcagccggattagataccctagtagtc

SEQ ID NO: 664 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaccttacaccttctttcgttcaacagtcagtcagccggattagataccctagtagtc

SEQ ID NO: 665 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtaggtgcttacccgaagattctgagtcagtcagccggattagataccctagtagtc

SEQ ID NO: 666 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgcatttggatggttggcgttacaagtcagtcagccggattagataccctagtagtc

SEQ ID NO: 667 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgataacatgtgcggaagtagcgagcagtcagtcagccggattagataccctagtagtc

SEQ ID NO: 668 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcttgagaaatcgttgcggaccctaagtcagtcagccggattagataccctagtagtc

SEQ ID NO: 669 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctacacagcacagcggaaacatggagtcagtcagccggattagataccctagtagtc

SEQ ID NO: 670 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggaaatgctacgtaacgttagtgtgagtcagtcagccggattagataccctagtagtc

SEQ ID NO: 671 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtctgaggttgcctgcatgacagtcagtcagtcagccggattagataccctagtagtc

SEQ ID NO: 672 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatcattctctctcaatcgctttcagtcagtcagccggattagataccctagtagtc

SEQ ID NO: 673 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagacataccgtactaccgattgcgagtcagtcagccggattagataccctagtagtc

SEQ ID NO: 674 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggatcctcatgcgtcacccaaggtaagtcagtcagccggattagataccctagtagtc

SEQ ID NO: 675 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgattatcgtccctagccagtcatacagtcagtcagccggattagataccctagtagtc

SEQ ID NO: 676 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgccagaccgctattaacggcgctctagtcagtcagccggattagataccctagtagtc

SEQ ID NO: 677 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgagctctagaaacgtttgctcgagaagtcagtcagccggattagataccctagtagtc

SEQ ID NO: 678 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtccatcgacgtgcaaacgcactaaagtcagtcagccggattagataccctagtagtc

SEQ ID NO: 679 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgatgtgtggttgaacaaagagcgagtcagtcagccggattagataccctagtagtc

SEQ ID NO: 680 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcgaagttgggagctaagtgatgtagtcagtcagccggattagataccctagtagtc

SEQ ID NO: 681 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcattcggcgttaagggacaagtgagtcagtcagccggattagataccctagtagtc

SEQ ID NO: 682 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgccattgtgcaagtgtcgattcgagtcagtcagccggattagataccctagtagtc

SEQ ID NO: 683 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtccaactgcagactattaagcggcagtcagtcagccggattagataccctagtagtc

SEQ ID NO: 684 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaaagacccgtacctaccattgttagtcagtcagccggattagataccctagtagtc

SEQ ID NO: 685 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtatcttcaccgagtccgttgctagtcagtcagccggattagataccctagtagtc

SEQ ID NO: 686 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggactgactcgtcgataactgtacgagtcagtcagccggattagataccctagtagtc

SEQ ID NO: 687 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcgtggatagcttaaacctggacaagtcagtcagccggattagataccctagtagtc

SEQ ID NO: 688 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggacgcactaactccgaattgacaaagtcagtcagccggattagataccctagtagtc

SEQ ID NO: 689 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggcgatttacgtctggcatctagcagtcagtcagccggattagataccctagtagtc

SEQ ID NO: 690 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaaggcatcgctggtggtcgttctagtcagtcagccggattagataccctagtagtc

SEQ ID NO: 691 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacccatacagccactatgggctaaagtcagtcagccggattagataccctagtagtc

SEQ ID NO: 692 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgcactacgcatgcattgagttcgagtcagtcagccggattagataccctagtagtc

SEQ ID NO: 693 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcagtcgttaagagttgctgagtccagtcagtcagccggattagataccctagtagtc

SEQ ID NO: 694 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctacgaaagcctctatggtgaaccagtcagtcagccggattagataccctagtagtc

SEQ ID NO: 695 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgataattgccgagggaccaagggatagtcagtcagccggattagataccctagtagtc

SEQ ID NO: 696 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggcatgttatcggtattggtcagaagtcagtcagccggattagataccctagtagtc

SEQ ID NO: 697 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaggcacagtaggagaaccgtcataagtcagtcagccggattagataccctagtagtc

SEQ ID NO: 698 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctacttacatccaactggaaccctagtcagtcagccggattagataccctagtagtc

SEQ ID NO: 699 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctcttctgatcaatactcggctgcagtcagtcagccggattagataccctagtagtc

SEQ ID NO: 700 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatgctaaccacgacgcttaacgacagtcagtcagccggattagataccctagtagtc

SEQ ID NO: 701 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaccaatctcggcagcttaccgaccagtcagtcagccggattagataccctagtagtc

SEQ ID NO: 702 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtatccaagcgcaagggctatagttagtcagtcagccggattagataccctagtagtc

SEQ ID NO: 703 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtactgaagatctgtctcgcaagcagtcagtcagccggattagataccctagtagtc

SEQ ID NO: 704 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcgccgtgtacacagccgcatatcagtcagtcagccggattagataccctagtagtc

SEQ ID NO: 705 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaactgcgatatggatacgttcgcaagtcagtcagccggattagataccctagtagtc

SEQ ID NO: 706 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcttccaactcatccaagattcgccagtcagtcagccggattagataccctagtagtc

SEQ ID NO: 707 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggagatcgcctatgaggctgatttaagtcagtcagccggattagataccctagtagtc

SEQ ID NO: 708 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtacatcgccggagttagcatcaagtcagtcagccggattagataccctagtagtc

SEQ ID NO: 709 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgttaagcagcatgtagtataggcagtcagtcagccggattagataccctagtagtc

SEQ ID NO: 710 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacggcgttatgtctcacgcaatgcagtcagtcagccggattagataccctagtagtc

SEQ ID NO: 711 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgactttgctttgcgtcccgtgaaatagtcagtcagccggattagataccctagtagtc

SEQ ID NO: 712 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcaaagcggtattggacagtgtattagtcagtcagccggattagataccctagtagtc

SEQ ID NO: 713 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgaaactacgtaacacgactatagagtcagtcagccggattagataccctagtagtc

SEQ ID NO: 714 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggaggaccagcaagtgtaggtgcttagtcagtcagccggattagataccctagtagtc

SEQ ID NO: 715 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaatagcatgtcgtgaactagcgtcagtcagtcagccggattagataccctagtagtc

SEQ ID NO: 716 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcggagtaatccttccgagtcaccaagtcagtcagccggattagataccctagtagtc

SEQ ID NO: 717 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctgtgtccatggtcctctttggtcagtcagtcagccggattagataccctagtagtc

SEQ ID NO: 718 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcttcgcggatgttccaccctctatagtcagtcagccggattagataccctagtagtc

SEQ ID NO: 719 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgataggctgtagttcgtgacgctaaagtcagtcagccggattagataccctagtagtc

SEQ ID NO: 720 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtgtgtagccatgacggctagttccagtcagtcagccggattagataccctagtagtc

SEQ ID NO: 721 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaagggcgctgaagcactggcatatagtcagtcagccggattagataccctagtagtc

SEQ ID NO: 722 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggtttccgtggtgggcattagttgaagtcagtcagccggattagataccctagtagtc

SEQ ID NO: 723 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaggaaccagacgcggtagttgatcagtcagtcagccggattagataccctagtagtc

SEQ ID NO: 724 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtaatgcccaggttgaaagcggcgaagtcagtcagccggattagataccctagtagtc

SEQ ID NO: 725 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtatgaacgtccgggttacggttacagtcagtcagccggattagataccctagtagtc

SEQ ID NO: 726 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgccacattgggtcacatcaggtcacagtcagtcagccggattagataccctagtagtc

SEQ ID NO: 727 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcagtcagatgagttgatacgatgagtcagtcagccggattagataccctagtagtc

SEQ ID NO: 728 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaagtcacacacacagacacttccgagtcagtcagccggattagataccctagtagtc

SEQ ID NO: 729 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggctgtgattcgatcaccatccgagagtcagtcagccggattagataccctagtagtc

SEQ ID NO: 730 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctagctatggacacccaccactagagtcagtcagccggattagataccctagtagtc

SEQ ID NO: 731 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcttgacgaggttcagaaggtgtggagtcagtcagccggattagataccctagtagtc

SEQ ID NO: 732 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacctgggaatatgaagcttgaatcagtcagtcagccggattagataccctagtagtc

SEQ ID NO: 733 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctctgcctaattactaggatcagtagtcagtcagccggattagataccctagtagtc

SEQ ID NO: 734 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatatgacccagcgctccttagaagagtcagtcagccggattagataccctagtagtc

SEQ ID NO: 735 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgctctattccacctcccattcccatagtcagtcagccggattagataccctagtagtc

SEQ ID NO: 736 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgattgagtgagtctggcgtcattcgagtcagtcagccggattagataccctagtagtc

SEQ ID NO: 737 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttatggtacggaaatcctcggagtagtcagtcagccggattagataccctagtagtc

SEQ ID NO: 738 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggctagttatggactggacgcattaagtcagtcagccggattagataccctagtagtc

SEQ ID NO: 739 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcagattaaccagaccgattaggtaagtcagtcagccggattagataccctagtagtc

SEQ ID NO: 740 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggctgcatactcatgtgctgctcgagtcagtcagccggattagataccctagtagtc

SEQ ID NO: 741 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttggtaaagtgctacgtacgaaacagtcagtcagccggattagataccctagtagtc

SEQ ID NO: 742 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaagtggctatccatcacattctccagtcagtcagccggattagataccctagtagtc

SEQ ID NO: 743 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgaaccgatgtaccagcctggtacctagtcagtcagccggattagataccctagtagtc

SEQ ID NO: 744 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtcgattggccgtgctaaagtcgtaagtcagtcagccggattagataccctagtagtc

SEQ ID NO: 745 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcattactggactctcagcgcgtaagtcagtcagccggattagataccctagtagtc

SEQ ID NO: 746 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttgggccacatagaccctagacctagtcagtcagccggattagataccctagtagtc

SEQ ID NO: 747 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcacacaaagtcatattcagcggacagtcagtcagccggattagataccctagtagtc

SEQ ID NO: 748 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggccaaggatagggttccggattagagtcagtcagccggattagataccctagtagtc

SEQ ID NO: 749 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgccacgtgtatgcgtgtaattagagtcagtcagccggattagataccctagtagtc

SEQ ID NO: 750 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggcaaccgattgtctgtagcttggcagtcagtcagccggattagataccctagtagtc

SEQ ID NO: 751 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcatgtgcttaggatgcctcgtaagagtcagtcagccggattagataccctagtagtc

SEQ ID NO: 752 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggttcctccattaacctatggtgaaagtcagtcagccggattagataccctagtagtc

SEQ ID NO: 753 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgacctgtcctttcctgttacagcgaagtcagtcagccggattagataccctagtagtc

SEQ ID NO: 754 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggttcacgcccaacagtcaggccttagtcagtcagccggattagataccctagtagtc

SEQ ID NO: 755 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgatcgaacactactgagctgcatagtcagtcagccggattagataccctagtagtc

SEQ ID NO: 756 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcatgccaacatgacgaagtctaccagtcagtcagccggattagataccctagtagtc

SEQ ID NO: 757 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggagtacagtctaaccgtctttctcagtcagtcagccggattagataccctagtagtc

SEQ ID NO: 758 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcctacatgagacagtctgtctgcgagtcagtcagccggattagataccctagtagtc

SEQ ID NO: 759 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtccgtggtatagccgcactcaagtagtcagtcagccggattagataccctagtagtc

SEQ ID NO: 760 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgtctacggcacgttgtggaaactccagtcagtcagccggattagataccctagtagtc

SEQ ID NO: 761 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgatgctgcaacacttaggcaggttcagtcagtcagccggattagataccctagtagtc

SEQ ID NO: 762 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgttctcatggaggtaagactactggagtcagtcagccggattagataccctagtagtc

SEQ ID NO: 763 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcatagtgattggcgcgaagtttcaagtcagtcagccggattagataccctagtagtc

SEQ ID NO: 764 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcggctatcaagacacgatacactgccagtcagtcagccggattagataccctagtagtc

SEQ ID NO: 765 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgccgtgacaactcttgaaatcccggagtcagtcagccggattagataccctagtagtc

SEQ ID NO: 766 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcgttccttgttagttagggagcgaagtcagtcagccggattagataccctagtagtc

SEQ ID NO: 767 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgggaattatcggtttactgtggccgagtcagtcagccggattagataccctagtagtc

SEQ ID NO: 768 - DNA, 84 bp, synthetic construct
  misc_feature 1..84: note = Description of Artificial Sequence: Synthetic oligonucleotide
  source 1..84: mol_type = other DNA
cctacgggaggcatcaggcagatctcgcatcaagcatagatataaggcccaagtcagtcagccggattagataccctagtagtc

SEQ ID NO: 769 - DNA, 3368 bp, synthetic construct
  misc_feature 1..3368: note = Description of Artificial Sequence: Synthetic polynucleotide
  source 1..3368: mol_type = other DNA
gtaacactggcagagcattacgctgacttgacgggacggcgcaagctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagctcttatggtttcccaagctgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctgcgatccggatctggatccagatcgggatctggatcaagcttggatcctatctcctttccctacgggaggcatcaggcagatctcgtcccttgtctccacgagactgattagtcagtcagccggattagataccctagtagtcgaaagttgagaccatggaattcgatctggatcttgatccggatcacgatctcgatcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcggtcttatggtttcccaagctggcctcgtgatacgcctatttttataggttaatgtcatgggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtcttgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatgtgaataaattgcagtttcatttgatgctcgatgagtttttctaatcagaattggttaattggtt

SEQ ID NO: 770 - DNA, 3368 bp, synthetic construct
  misc_feature 1..3368: note = Description of Artificial Sequence: Synthetic polynucleotide
  source 1..3368: mol_type = other DNA
gtaacactggcagagcattacgctgacttgacgggacggcgcaagctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagctcttatggtttcccaagctgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctgcgatccggatctggatccagatcgggatctggatcaagcttggatcctatctcctttccctacgggaggcatcaggcagatctcggctgtacggattatcaccaggtgtagtcagtcagccggattagataccctagtagtcgaaagttgagaccatggaattcgatctggatcttgatccggatcacgatctcgatcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcggtcttatggtttcccaagctggcctcgtgatacgcctatttttataggttaatgtcatgggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtcttgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatgtgaataaattgcagtttcatttgatgctcgatgagtttttctaatcagaattggttaattggtt

SEQ ID NO: 771 - DNA, 84 bp, synthetic construct; identical to SEQ ID NO: 385
  misc_feature 1..84: note = Description of Artificial Sequence: Synthetic oligonucleotide
  source 1..84: mol_type = other DNA

SEQ ID NO: 772 - DNA, 84 bp, synthetic construct; identical to SEQ ID NO: 386
  misc_feature 1..84: note = Description of Artificial Sequence: Synthetic oligonucleotide
  source 1..84: mol_type = other DNA

SEQ ID NO: 773 - DNA, 50 bp, synthetic construct
  misc_feature 1..50: note = Description of Artificial Sequence: Synthetic primer
  variation 42: note = A, T, C or G
  source 1..50: mol_type = other DNA
tcgtcggcagcgtcagatgtgtataagagacagcctacgggnggcwgcag

SEQ ID NO: 774 - DNA, 55 bp, synthetic construct
  misc_feature 1..55: note = Description of Artificial Sequence: Synthetic primer
  source 1..55: mol_type = other DNA
gtctcgtgggctcggagatgtgtataagagacaggactachvgggtatctaatcc

SEQ ID NO: 775 - DNA, 12 bp, synthetic construct
  misc_feature 1..12: note = Description of Artificial Sequence: Synthetic oligonucleotide
  source 1..12: mol_type = other DNA
tggtcaacgata

SEQ ID NO: 776 - DNA, 12 bp, synthetic construct
  misc_feature 1..12: note = Description of Artificial Sequence: Synthetic oligonucleotide
  source 1..12: mol_type = other DNA
catcgcgttgac

SEQ ID NO: 777 - DNA, 12 bp, synthetic construct
  misc_feature 1..12: note = Description of Artificial Sequence: Synthetic oligonucleotide
  source 1..12: mol_type = other DNA
acgtaaccacgt

SEQ ID NO: 778 - DNA, 12 bp, synthetic construct
  misc_feature 1..12: note = Description of Artificial Sequence: Synthetic oligonucleotide
  source 1..12: mol_type = other DNA
cttcttcgccct

SEQ ID NO: 779 - DNA, 12 bp, synthetic construct
  misc_feature 1..12: note = Description of Artificial Sequence: Synthetic oligonucleotide
  source 1..12: mol_type = other DNA
gacggctatgtt

SEQ ID NO: 780 - DNA, 12 bp, synthetic construct
  misc_feature 1..12: note = Description of Artificial Sequence: Synthetic oligonucleotide
  source 1..12: mol_type = other DNA
gtcattgggcta

SEQ ID NO: 781 - DNA, 12 bp, synthetic construct
  misc_feature 1..12: note = Description of Artificial Sequence: Synthetic oligonucleotide
  source 1..12: mol_type = other DNA
atcgcacagtaa

SEQ ID NO: 782 - DNA, 12 bp, synthetic construct
  misc_feature 1..12: note = Description of Artificial Sequence: Synthetic oligonucleotide
  source 1..12: mol_type = other DNA
gcacatagtcgt

SEQ ID NO: 783 - DNA, 12 bp, synthetic construct
  misc_feature 1..12: note = Description of Artificial Sequence: Synthetic oligonucleotide
  source 1..12: mol_type = other DNA
gtcggaaattgt

SEQ ID NO: 784 - DNA, 12 bp, synthetic construct
  misc_feature 1..12: note = Description of Artificial Sequence: Synthetic oligonucleotide
  source 1..12: mol_type = other DNA
caggcataacat

SEQ ID NO: 785 - DNA, 12 bp, synthetic construct
  misc_feature 1..12: note = Description of Artificial Sequence: Synthetic oligonucleotide
  source 1..12: mol_type = other DNA
tctctttcgaca

SEQ ID NO: 786 - DNA, 12 bp, synthetic construct
  misc_feature 1..12: note = Description of Artificial Sequence: Synthetic oligonucleotide
  source 1..12: mol_type = other DNA
agagacgcgtag

SEQ ID NO: 787 - DNA, 12 bp, synthetic construct
  misc_feature 1..12: note = Description of Artificial Sequence: Synthetic oligonucleotide
  source 1..12: mol_type = other DNA
gtcgtgtagcct

SEQ ID NO: 788 - DNA, 12 bp, synthetic construct
  misc_feature 1..12: note = Description of Artificial Sequence: Synthetic oligonucleotide
  source 1..12: mol_type = other DNA
ggcaaatacact

SEQ ID NO: 789 - DNA, 12 bp, synthetic construct
  misc_feature 1..12: note = Description of Artificial Sequence: Synthetic oligonucleotide
  source 1..12: mol_type = other DNA
tctaacgagtgc

SEQ ID NO: 790 - DNA, 12 bp, synthetic construct
  misc_feature 1..12: note = Description of Artificial Sequence: Synthetic oligonucleotide
  source 1..12: mol_type = other DNA
atgtggcgtgtt

SEQ ID NO: 791 - DNA, 12 bp, synthetic construct
  misc_feature 1..12: note = Description of Artificial Sequence: Synthetic oligonucleotide
  source 1..12: mol_type = other DNA
gattaggttccg

SEQ ID NO: 792 - DNA, 12 bp, synthetic construct
  misc_feature 1..12: note = Description of Artificial Sequence: Synthetic oligonucleotide
  source 1..12: mol_type = other DNA
ttaatggatcgg

SEQ ID NO: 793 - DNA, 12 bp, synthetic construct
  misc_feature 1..12: note = Description of Artificial Sequence: Synthetic oligonucleotide
  source 1..12: mol_type = other DNA
agcggaggttag

SEQ ID NO: 794 - DNA, 12 bp, synthetic construct
  misc_feature 1..12: note = Description of Artificial Sequence: Synthetic oligonucleotide
  source 1..12: mol_type = other DNA
gtcatgctccag

SEQ ID NO: 795 - DNA, 12 bp, synthetic construct
  misc_feature 1..12: note = Description of Artificial Sequence: Synthetic oligonucleotide
  source 1..12: mol_type = other DNA
catctgggcaat

SEQ ID NO: 796 - DNA, 12 bp, synthetic construct
  misc_feature 1..12: note = Description of Artificial Sequence: Synthetic oligonucleotide
  source 1..12: mol_type = other DNA
gtgcggttcact

SEQ ID NO: 797 - DNA, 12 bp, synthetic construct
  misc_feature 1..12: note = Description of Artificial Sequence: Synthetic oligonucleotide
  source 1..12: mol_type = other DNA
ctactccacgag

SEQ ID NO: 798 - DNA, 12 bp, synthetic construct
  misc_feature 1..12: note = Description of Artificial Sequence: Synthetic oligonucleotide
  source 1..12: mol_type = other DNA
atattggcagcc

SEQ ID NO: 799 - DNA, 12 bp, synthetic construct
  misc_feature 1..12: note = Description of Artificial Sequence: Synthetic oligonucleotide
  source 1..12: mol_type = other DNA
atcctttggttc

SEQ ID NO: 800 - DNA, 12 bp, synthetic construct
  misc_feature 1..12: note = Description of Artificial Sequence: Synthetic oligonucleotide
  source 1..12: mol_type = other DNA
cctagtaagctg

SEQ ID NO: 801 - DNA, 12 bp, synthetic construct
  misc_feature 1..12: note = Description of Artificial Sequence: Synthetic oligonucleotide
  source 1..12: mol_type = other DNA
tgtccgtggatc

SEQ ID NO: 802 - DNA, 12 bp, synthetic construct
  misc_feature 1..12: note = Description of Artificial Sequence: Synthetic oligonucleotide
  source 1..12: mol_type = other DNA
cctcactagcga

SEQ ID NO: 803 - DNA, 12 bp, synthetic construct
  misc_feature 1..12: note = Description of Artificial Sequence: Synthetic oligonucleotide
  source 1..12: mol_type = other DNA
ggtgcagacaga

SEQ ID NO: 804 - DNA, 12 bp, synthetic construct
  misc_feature 1..12: note = Description of Artificial Sequence: Synthetic oligonucleotide
  source 1..12: mol_type = other DNA
tcgcatggatac

SEQ ID NO: 805 - DNA, 12 bp, synthetic construct
  misc_feature 1..12: note = Description of Artificial Sequence: Synthetic oligonucleotide
  source 1..12: mol_type = other DNA
tacagcgcatac

SEQ ID NO: 806 - DNA, 12 bp, synthetic construct
  misc_feature 1..12: note = Description of Artificial Sequence: Synthetic oligonucleotide
  source 1..12: mol_type = other DNA
ttaccgacgagt

SEQ ID NO: 807 - DNA, 12 bp, synthetic construct
  misc_feature 1..12: note = Description of Artificial Sequence: Synthetic oligonucleotide
  source 1..12: mol_type = other DNA
actcggccaact

SEQ ID NO: 808 - DNA, 12 bp, synthetic construct
  misc_feature 1..12: note = Description of Artificial Sequence: Synthetic oligonucleotide
  source 1..12: mol_type = other DNA
agctgatagttg

SEQ ID NO: 809 - DNA, 12 bp, synthetic construct
  misc_feature 1..12: note = Description of Artificial Sequence: Synthetic oligonucleotide
  source 1..12: mol_type = other DNA
ccgtaccgtatg

SEQ ID NO: 810 - DNA, 12 bp, synthetic construct
  misc_feature 1..12: note = Description of Artificial Sequence: Synthetic oligonucleotide
  source 1..12: mol_type = other DNA
caacaatgccaa

SEQ ID NO: 811 - DNA, 12 bp, synthetic construct
  misc_feature 1..12: note = Description of Artificial Sequence: Synthetic oligonucleotide
  source 1..12: mol_type = other DNA
accggtatgtac

SEQ ID NO: 812 - DNA, 12 bp, synthetic construct
  misc_feature 1..12: note = Description of Artificial Sequence: Synthetic oligonucleotide
  source 1..12: mol_type = other DNA
gcttagatgtag

SEQ ID NO: 813 - DNA, 12 bp, synthetic construct
  misc_feature 1..12: note = Description of Artificial Sequence: Synthetic oligonucleotide
  source 1..12: mol_type = other DNA
gttggttggcat

SEQ ID NO: 814 - DNA, 12 bp, synthetic construct
  misc_feature 1..12: note = Description of Artificial Sequence: Synthetic oligonucleotide
  source 1..12: mol_type = other DNA
gctctagtaacg

SEQ ID NO: 815 - DNA, 12 bp, synthetic construct
  misc_feature 1..12: note = Description of Artificial Sequence: Synthetic oligonucleotide
  source 1..12: mol_type = other DNA
atgtccgaccaa

SEQ ID NO: 816 - DNA, 12 bp, synthetic construct
  misc_feature 1..12: note = Description of Artificial Sequence: Synthetic oligonucleotide
  source 1..12: mol_type = other DNA
gcccgacatata

SEQ ID NO: 817 - DNA, 12 bp, synthetic construct
  misc_feature 1..12: note = Description of Artificial Sequence: Synthetic oligonucleotide
  source 1..12: mol_type = other DNA
aattgtgtcgga

SEQ ID NO: 818 - DNA, 12 bp, synthetic construct
  misc_feature 1..12: note = Description of Artificial Sequence: Synthetic oligonucleotide
  source 1..12: mol_type = other DNA
aagacgtagcgg

SEQ ID NO: 819 - DNA, 12 bp, synthetic construct
  misc_feature 1..12: note = Description of Artificial Sequence: Synthetic oligonucleotide
  source 1..12: mol_type = other DNA
ttccacacgtgg

SEQ ID NO: 820 - DNA, 12 bp, synthetic construct
  misc_feature 1..12: note = Description of Artificial Sequence: Synthetic oligonucleotide
  source 1..12: mol_type = other DNA
tggtcctacaag

SEQ ID NO: 821 - DNA, 12 bp, synthetic construct
  misc_feature 1..12: note = Description of Artificial Sequence: Synthetic oligonucleotide
  source 1..12: mol_type = other DNA
agatgggactgg

SEQ ID NO: 822 - DNA, 12 bp, synthetic construct
  misc_feature 1..12: note = Description of Artificial Sequence: Synthetic oligonucleotide
  source 1..12: mol_type = other DNA
gattgaacgcta

SEQ ID NO: 823 - DNA, 12 bp, synthetic construct
  misc_feature 1..12: note = Description of Artificial Sequence: Synthetic oligonucleotide
  source 1..12: mol_type = other DNA
tgcatacactgg

SEQ ID NO: 824 - DNA, 12 bp, synthetic construct
  misc_feature 1..12: note = Description of Artificial Sequence: Synthetic oligonucleotide
  source 1..12: mol_type = other DNA
ttaccttacacc

SEQ ID NO: 825 - DNA, 12 bp, synthetic construct
  misc_feature 1..12: note = Description of Artificial Sequence: Synthetic oligonucleotide
  source 1..12: mol_type = other DNA
aacccagatgat

SEQ ID NO: 826 - DNA, 12 bp, synthetic construct
  misc_feature 1..12: note = Description of Artificial Sequence: Synthetic oligonucleotide
  source 1..12: mol_type = other DNA
cgctatccagac

SEQ ID NO: 827 - DNA, 12 bp, synthetic construct
  misc_feature 1..12: note = Description of Artificial Sequence: Synthetic oligonucleotide
  source 1..12: mol_type = other DNA
gtgcccacttga

SEQ ID NO: 828 - DNA, 12 bp, synthetic construct
  misc_feature 1..12: note = Description of Artificial Sequence: Synthetic oligonucleotide
  source 1..12: mol_type = other DNA
agtattcgcgca

SEQ ID NO: 829 - DNA, 12 bp, synthetic construct
  misc_feature 1..12: note = Description of Artificial Sequence: Synthetic oligonucleotide
  source 1..12: mol_type = other DNA
agtcgaacgagg

SEQ ID NO: 830 - DNA, 12 bp, synthetic construct
  misc_feature 1..12: note = Description of Artificial Sequence: Synthetic oligonucleotide
  source 1..12: mol_type = other DNA
tgactaatggcc

SEQ ID NO: 831 - DNA, 12 bp, synthetic construct
  misc_feature 1..12: note = Description of Artificial Sequence: Synthetic oligonucleotide
  source 1..12: mol_type = other DNA
gtagtgtcaaca

SEQ ID NO: 832 - DNA, 12 bp, synthetic construct
  misc_feature 1..12: note = Description of Artificial Sequence: Synthetic oligonucleotide
  source 1..12: mol_type = other DNA
gcttacgtaggt

SEQ ID NO: 833 - DNA, 12 bp, synthetic construct
  misc_feature 1..12: note = Description of Artificial Sequence: Synthetic oligonucleotide
  source 1..12: mol_type = other DNA
accgaacaatcc

SEQ ID NO: 834 - DNA, 12 bp, synthetic construct
  misc_feature 1..12: note = Description of Artificial Sequence: Synthetic oligonucleotide
  source 1..12: mol_type = other DNA
tgccaacaacaa

SEQ ID NO: 835 - DNA, 12 bp, synthetic construct
  misc_feature 1..12: note = Description of Artificial Sequence: Synthetic oligonucleotide
  source 1..12: mol_type = other DNA
accagtgactca

SEQ ID NO: 836 - DNA, 12 bp, synthetic construct
  misc_feature 1..12: note = Description of Artificial Sequence: Synthetic oligonucleotide
  source 1..12: mol_type = other DNA
ctctctcacttg

SEQ ID NO: 837 - DNA, 12 bp, synthetic construct
  misc_feature 1..12: note = Description of Artificial Sequence: Synthetic oligonucleotide
  source 1..12: mol_type = other DNA
tggagaggagat

SEQ ID NO: 838 - DNA, 12 bp, synthetic construct
  misc_feature 1..12: note = Description of Artificial Sequence: Synthetic oligonucleotide
  source 1..12: mol_type = other DNA
agttggttacga

SEQ ID NO: 839 - DNA, 12 bp, synthetic construct
  misc_feature 1..12: note = Description of Artificial Sequence: Synthetic oligonucleotide
  source 1..12: mol_type = other DNA
gtctaccacgca

SEQ ID NO: 840 - DNA, 12 bp, synthetic construct
  misc_feature 1..12: note = Description of Artificial Sequence: Synthetic oligonucleotide
  source 1..12: mol_type = other DNA
ctaaagtagcac

SEQ ID NO: 841 - DNA, 12 bp, synthetic construct
  misc_feature 1..12: note = Description of Artificial Sequence: Synthetic oligonucleotide
  source 1..12: mol_type = other DNA
gaataccaagtc

SEQ ID NO: 842 - DNA, 12 bp, synthetic construct
  misc_feature 1..12: note = Description of Artificial Sequence: Synthetic oligonucleotide
  source 1..12: mol_type = other DNA
attgcaagcaac

SEQ ID NO: 843 - DNA, 12 bp, synthetic construct
  misc_feature 1..12: note = Description of Artificial Sequence: Synthetic oligonucleotide
  source 1..12: mol_type = other DNA
cgtataaatgcg

SEQ ID NO: 844 - DNA, 12 bp, synthetic construct
  misc_feature 1..12: note = Description of Artificial Sequence: Synthetic oligonucleotide
  source 1..12: mol_type = other DNA
ctctacgaacag

SEQ ID NO: 845 - DNA, 12 bp, synthetic construct
  misc_feature 1..12: note = Description of Artificial Sequence: Synthetic oligonucleotide
  source 1..12: mol_type = other DNA
tcgcgtccagta

SEQ ID NO: 846 - DNA, 12 bp, synthetic construct
  misc_feature 1..12: note = Description of Artificial Sequence: Synthetic oligonucleotide
  source 1..12: mol_type = other DNA
agtgctaggtta

SEQ ID NO: 847 - DNA, 12 bp, synthetic construct
  misc_feature 1..12: note = Description of Artificial Sequence: Synthetic oligonucleotide
  source 1..12: mol_type = other DNA
gtagatcgtgta

SEQ ID NO: 848 - DNA, 12 bp, synthetic construct
  misc_feature 1..12: note = Description of Artificial Sequence: Synthetic oligonucleotide
  source 1..12: mol_type = other DNA
cacgtgacatgt

SEQ ID NO: 849 - DNA, 12 bp, synthetic construct
  misc_feature 1..12: note = Description of Artificial Sequence: Synthetic oligonucleotide
  source 1..12: mol_type = other DNA
aatacagacctg

SEQ ID NO: 850 - DNA, 12 bp, synthetic construct
  misc_feature 1..12: note = Description of Artificial Sequence: Synthetic oligonucleotide
  source 1..12: mol_type = other DNA
cctgtgttggtg

SEQ ID NO: 851 - DNA, 12 bp, synthetic construct
  misc_feature 1..12: note = Description of Artificial Sequence: Synthetic oligonucleotide
  source 1..12: mol_type = other DNA
gcctgattaagc

SEQ ID NO: 852 - DNA, 12 bp, synthetic construct
  misc_feature 1..12: note = Description of Artificial Sequence: Synthetic oligonucleotide
  source 1..12: mol_type = other DNA
cggaaactccat

SEQ ID NO: 853 - DNA, 12 bp, synthetic construct
  misc_feature 1..12: note = Description of Artificial Sequence: Synthetic oligonucleotide
  source 1..12: mol_type = other DNA
taacgtgtgtgc

SEQ ID NO: 854 - DNA, 12 bp, synthetic construct
  misc_feature 1..12: note = Description of Artificial Sequence: Synthetic oligonucleotide
  source 1..12: mol_type = other DNA
cacagttgaagt

SEQ ID NO: 855 - DNA, 12 bp, synthetic construct
  misc_feature 1..12: note = Description of Artificial Sequence: Synthetic oligonucleotide
  source 1..12: mol_type = other DNA
gactcaaccagt

SEQ ID NO: 856 - DNA, 12 bp, synthetic construct
  misc_feature 1..12: note = Description of Artificial Sequence: Synthetic oligonucleotide
  source 1..12: mol_type = other DNA
gatgggaggact

SEQ ID NO: 857 - DNA, 12 bp, synthetic construct
  misc_feature 1..12: note = Description of Artificial Sequence: Synthetic oligonucleotide
  source 1..12: mol_type = other DNA
acgtattcgaag

SEQ ID NO: 858 - DNA, 12 bp, synthetic construct
  misc_feature 1..12: note = Description of Artificial Sequence: Synthetic oligonucleotide
  source 1..12: mol_type = other DNA
aggaaagccaga

SEQ ID NO: 859 - DNA, 12 bp, synthetic construct
  misc_feature 1..12: note = Description of Artificial Sequence: Synthetic oligonucleotide
  source 1..12: mol_type = other DNA
cattatggcgtg

SEQ ID NO: 860 - DNA, 12 bp, synthetic construct
  misc_feature 1..12: note = Description of Artificial Sequence: Synthetic oligonucleotide
  source 1..12: mol_type = other DNA
ctaggatcactg

SEQ ID NO: 861 - DNA, 12 bp, synthetic construct
  misc_feature 1..12: note = Description of Artificial Sequence: Synthetic oligonucleotide
  source 1..12: mol_type = other DNA
ggaagaagtagc

SEQ ID NO: 862 - DNA, 12 bp, synthetic construct
  misc_feature 1..12: note = Description of Artificial Sequence: Synthetic oligonucleotide
  source 1..12: mol_type = other DNA
cagaatcgctca

SEQ ID NO: 863 - DNA, 12 bp, synthetic construct
  misc_feature 1..12: note = Description of Artificial Sequence: Synthetic oligonucleotide
  source 1..12: mol_type = other DNA
cggctactatgc

SEQ ID NO: 864 - DNA, 12 bp, synthetic construct
  misc_feature 1..12: note = Description of Artificial Sequence: Synthetic oligonucleotide
  source 1..12: mol_type = other DNA
gtctgacggtct

SEQ ID NO: 865 - DNA, 12 bp, synthetic construct
  misc_feature 1..12: note = Description of Artificial Sequence: Synthetic oligonucleotide
  source 1..12: mol_type = other DNA
ccaatacgcctg

SEQ ID NO: 866 - DNA, 12 bp, synthetic construct
  misc_feature 1..12: note = Description of Artificial Sequence: Synthetic oligonucleotide
  source 1..12: mol_type = other DNA
gatgacccaaat

SEQ ID NO: 867 - DNA, 12 bp, synthetic construct
  misc_feature 1..12: note = Description of Artificial Sequence: Synthetic oligonucleotide
  source 1..12: mol_type = other DNA
atcgatccacag

SEQ ID NO: 868 - DNA, 12 bp, synthetic construct
  misc_feature 1..12: note = Description of Artificial Sequence: Synthetic oligonucleotide
  source 1..12: mol_type = other DNA
tggcactggtta

SEQ ID NO: 869 - DNA, 12 bp, synthetic construct
  misc_feature 1..12: note = Description of Artificial Sequence: Synthetic oligonucleotide
  source 1..12: mol_type = other DNA
agttcggcattg

SEQ ID NO: 870 - DNA, 12 bp, synthetic construct
  misc_feature 1..12: note = Description of Artificial Sequence: Synthetic oligonucleotide
  source 1..12: mol_type = other DNA
gaaaccaagctt

SEQ ID NO: 871 - DNA, 12 bp, synthetic construct
  misc_feature 1..12: note = Description of Artificial Sequence: Synthetic oligonucleotide
  source 1..12: mol_type = other DNA
gatctgcgatcc

SEQ ID NO: 872 - DNA, 12 bp, synthetic construct
  misc_feature 1..12: note = Description of Artificial Sequence: Synthetic oligonucleotide
  source 1..12: mol_type = other DNA
accggagtagga

SEQ ID NO: 873 - DNA, 12 bp, synthetic construct
  misc_feature 1..12: note = Description of Artificial Sequence: Synthetic oligonucleotide
  source 1..12: mol_type = other DNA
acaccgcacaat

SEQ ID NO: 874 - DNA, 12 bp, synthetic construct
  misc_feature 1..12: note = Description of Artificial Sequence: Synthetic oligonucleotide
  source 1..12: mol_type = other DNA
ggcagtgttaat

SEQ ID NO: 875 - DNA, 12 bp, synthetic construct
  misc_feature 1..12: note = Description of Artificial Sequence: Synthetic oligonucleotide
  source 1..12: mol_type = other DNA
ttgggagcgaag

SEQ ID NO: 876 - DNA, 12 bp, synthetic construct
  misc_feature 1..12: note = Description of Artificial Sequence: Synthetic oligonucleotide
  source 1..12: mol_type = other DNA
tcatcacgggct

SEQ ID NO: 877 - DNA, 12 bp, synthetic construct
  misc_feature 1..12: note = Description of Artificial Sequence: Synthetic oligonucleotide
  source 1..12: mol_type = other DNA
cagctcatcagc

SEQ ID NO: 878 - DNA, 12 bp, synthetic construct
  misc_feature 1..12: note = Description of Artificial Sequence: Synthetic oligonucleotide
  source 1..12: mol_type = other DNA
tgaggactacct

SEQ ID NO: 879 - DNA, 12 bp, synthetic construct
  misc_feature 1..12: note = Description of Artificial Sequence: Synthetic oligonucleotide
  source 1..12: mol_type = other DNA
gtctcctccctt

SEQ ID NO: 880 - DNA, 12 bp, synthetic construct
  misc_feature 1..12: note = Description of Artificial Sequence: Synthetic oligonucleotide
  source 1..12: mol_type = other DNA
aacccgtcgtca

SEQ ID NO: 881 - DNA, 12 bp, synthetic construct
  misc_feature 1..12: note = Description of Artificial Sequence: Synthetic oligonucleotide
  source 1..12: mol_type = other DNA
tgttcgcccaga

SEQ ID NO: 882 - DNA, 12 bp, synthetic construct
  misc_feature 1..12: note = Description of Artificial Sequence: Synthetic oligonucleotide
  source 1..12: mol_type = other DNA
tgttctgagacg

SEQ ID NO: 883 - DNA, 12 bp, synthetic construct
  misc_feature 1..12: note = Description of Artificial Sequence: Synthetic oligonucleotide
  source 1..12: mol_type = other DNA
caaacaacagct

SEQ ID NO: 884 - DNA, 12 bp, synthetic construct
  misc_feature 1..12: note = Description of Artificial Sequence: Synthetic oligonucleotide
  source 1..12: mol_type = other DNA
caatcggcttgc

SEQ ID NO: 885 - DNA, 12 bp, synthetic construct
  misc_feature 1..12: note = Description of Artificial Sequence: Synthetic oligonucleotide
  source 1..12: mol_type = other DNA
gtagcactcatg

SEQ ID NO: 886 - DNA, 12 bp, synthetic construct
  misc_feature 1..12: note = Description of Artificial Sequence: Synthetic oligonucleotide
  source 1..12: mol_type = other DNA
agaggagtcgac

SEQ ID NO: 887 - DNA, 12 bp, synthetic construct
  misc_feature 1..12: note = Description of Artificial Sequence: Synthetic oligonucleotide
  source 1..12: mol_type = other DNA
cgcgtatctcag

SEQ ID NO: 888 - DNA, 12 bp, synthetic construct
  misc_feature 1..12: note = Description of Artificial Sequence: Synthetic oligonucleotide
  source 1..12: mol_type = other DNA
atagcaccagat

SEQ ID NO: 889 - DNA, 12 bp, synthetic construct
  misc_feature 1..12: note = Description of Artificial Sequence: Synthetic oligonucleotide
  source 1..12: mol_type = other DNA
gcaacaccatcc

SEQ ID NO: 890 - DNA, 12 bp, synthetic construct
  misc_feature 1..12: note = Description of Artificial Sequence: Synthetic oligonucleotide
  source 1..12: mol_type = other DNA
aacactcgatcg

SEQ ID NO: 891 - DNA, 12 bp, synthetic construct
  misc_feature 1..12: note = Description of Artificial Sequence: Synthetic oligonucleotide
  source 1..12: mol_type = other DNA
cacctgtagtag

SEQ ID NO: 892 - DNA, 12 bp, synthetic construct
  misc_feature 1..12: note = Description of Artificial Sequence: Synthetic oligonucleotide
  source 1..12: mol_type = other DNA
taagtcggccta

SEQ ID NO: 893 - DNA, 12 bp, synthetic construct
  misc_feature 1..12: note = Description of Artificial Sequence: Synthetic oligonucleotide
  source 1..12: mol_type = other DNA
cgaaagcattcc

SEQ ID NO: 894 - DNA, 12 bp, synthetic construct
  misc_feature 1..12: note = Description of Artificial Sequence: Synthetic oligonucleotide
  source 1..12: mol_type = other DNA
atctcgctgggt

SEQ ID NO: 895 - DNA, 12 bp, synthetic construct
  misc_feature 1..12: note = Description of Artificial Sequence: Synthetic oligonucleotide
  source 1..12: mol_type = other DNA
gcgatatatcgc

SEQ ID NO: 896 - DNA, 12 bp, synthetic construct
  misc_feature 1..12: note = Description of Artificial Sequence: Synthetic oligonucleotide
  source 1..12: mol_type = other DNA
tgaccggctgtt

SEQ ID NO: 897 - DNA, 12 bp, synthetic construct
  misc_feature 1..12: note = Description of Artificial Sequence: Synthetic oligonucleotide
  source 1..12: mol_type = other DNA
cacgagctactc

SEQ ID NO: 898 - DNA, 12 bp, synthetic construct
  misc_feature 1..12: note = Description of Artificial Sequence: Synthetic oligonucleotide
  source 1..12: mol_type = other DNA
cagggtagggta

SEQ ID NO: 899 - DNA, 12 bp, synthetic construct
  misc_feature 1..12: note = Description of Artificial Sequence: Synthetic oligonucleotide
  source 1..12: mol_type = other DNA
ccggacaagaag

SEQ ID NO: 900 - DNA, 12 bp, synthetic construct
  misc_feature 1..12: note = Description of Artificial Sequence: Synthetic oligonucleotide
  source 1..12: mol_type = other DNA
gcgcgtgtatct

SEQ ID NO: 901 - DNA, 12 bp, synthetic construct
  misc_feature 1..12: note = Description of Artificial Sequence: Synthetic oligonucleotide
  source 1..12: mol_type = other DNA
cgagcaatccta

SEQ ID NO: 902 - DNA, 12 bp, synthetic construct
  misc_feature 1..12: note = Description of Artificial Sequence: Synthetic oligonucleotide
  source 1..12: mol_type = other DNA
ggaggagcaata

SEQ ID NO: 903 - DNA, 12 bp, synthetic construct
  misc_feature 1..12: note = Description of Artificial Sequence: Synthetic oligonucleotide
  source 1..12: mol_type = other DNA
tctcgataagcg

SEQ ID NO: 904 - DNA, 12 bp, synthetic construct
  misc_feature 1..12: note = Description of Artificial Sequence: Synthetic oligonucleotide
  source 1..12: mol_type = other DNA
catgggtgttac

SEQ ID NO: 905 - DNA, 12 bp, synthetic construct
  misc_feature 1..12: note = Description of Artificial Sequence: Synthetic oligonucleotide
  source 1..12: mol_type = other DNA
cgatccgatctg

SEQ ID NO: 906 - DNA, 12 bp, synthetic construct
  misc_feature 1..12: note = Description of Artificial Sequence: Synthetic oligonucleotide
  source 1..12: mol_type = other DNA
aacgcgaaattc

SEQ ID NO: 907 - DNA, 12 bp, synthetic construct
  misc_feature 1..12: note = Description of Artificial Sequence: Synthetic oligonucleotide
  source 1..12: mol_type = other DNA
agtcgtgcacat

SEQ ID NO: 908 - DNA, 12 bp, synthetic construct
  misc_feature 1..12: note = Description of Artificial Sequence: Synthetic oligonucleotide
  source 1..12: mol_type = other DNA
agcgacgaagac

SEQ ID NO: 909 - DNA, 12 bp, synthetic construct
  misc_feature 1..12: note = Description of Artificial Sequence: Synthetic oligonucleotide
  source 1..12: mol_type = other DNA
tagacaccgtgt

SEQ ID NO: 910 - DNA, 12 bp, synthetic construct
  misc_feature 1..12: note = Description of Artificial Sequence: Synthetic oligonucleotide
  source 1..12: mol_type = other DNA
gatgcctaatga

SEQ ID NO: 911 - DNA, 12 bp, synthetic construct
  misc_feature 1..12: note = Description of Artificial Sequence: Synthetic oligonucleotide
  source 1..12: mol_type = other DNA
tgcatcgcgtca

SEQ ID NO: 912 - DNA, 12 bp, synthetic construct
  misc_feature 1..12: note = Description of Artificial Sequence: Synthetic oligonucleotide
  source 1..12: mol_type = other DNA
atctggacgatc

SEQ ID NO: 913 - DNA, 12 bp, synthetic construct
  misc_feature 1..12: note = Description of Artificial Sequence: Synthetic oligonucleotide
  source 1..12: mol_type = other DNA
gtatctgcgcgt

SEQ ID NO: 914 - DNA, 12 bp, synthetic construct
  misc_feature 1..12: note = Description of Artificial Sequence: Synthetic oligonucleotide
  source 1..12: mol_type = other DNA
cttccctaactc

SEQ ID NO: 915 - DNA, 12 bp, synthetic construct
  misc_feature 1..12: note = Description of Artificial Sequence: Synthetic oligonucleotide
  source 1..12: mol_type = other DNA
agacaagcttcc

SEQ ID NO: 916 - DNA, 12 bp, synthetic construct
  misc_feature 1..12: note = Description of Artificial Sequence: Synthetic oligonucleotide
  source 1..12: mol_type = other DNA
ttatcgggcatg

SEQ ID NO: 917 - DNA, 12 bp, synthetic construct
  misc_feature 1..12: note = Description of Artificial Sequence: Synthetic oligonucleotide
  source 1..12: mol_type = other DNA
atggacctagct

SEQ ID NO: 918 - DNA, 12 bp, synthetic construct
  misc_feature 1..12: note = Description of Artificial Sequence: Synthetic oligonucleotide
  source 1..12: mol_type = other DNA
ccagctggactt

SEQ ID NO: 919 - DNA, 12 bp, synthetic construct
  misc_feature 1..12: note = Description of Artificial Sequence: Synthetic oligonucleotide
  source 1..12: mol_type = other DNA
cgagggaaagtc

SEQ ID NO: 920 - DNA, 12 bp, synthetic construct
  misc_feature 1..12: note = Description of Artificial Sequence: Synthetic oligonucleotide
  source 1..12: mol_type = other DNA
tggaagaacggc

SEQ ID NO: 921 - DNA, 12 bp, synthetic construct
  misc_feature 1..12: note = Description of Artificial Sequence: Synthetic oligonucleotide
  source 1..12: mol_type = other DNA
tccgcaacctga

SEQ ID NO: 922 - DNA, 12 bp, synthetic construct
  misc_feature 1..12: note = Description of Artificial Sequence: Synthetic oligonucleotide
  source 1..12: mol_type = other DNA
tggacataaacc

SEQ ID NO: 923 - DNA, 12 bp, synthetic construct
  misc_feature 1..12: note = Description of Artificial Sequence: Synthetic oligonucleotide
  source 1..12: mol_type = other DNA
aggaatactcac

SEQ ID NO: 924 - DNA, 12 bp, synthetic construct
  misc_feature 1..12: note = Description of Artificial Sequence: Synthetic oligonucleotide
  source 1..12: mol_type = other DNA
ctctaacctcta

SEQ ID NO: 925 - DNA, 12 bp, synthetic construct
  misc_feature 1..12: note = Description of Artificial Sequence: Synthetic oligonucleotide
  source 1..12: mol_type = other DNA
caaattcgggat

SEQ ID NO: 926 - DNA, 12 bp, synthetic construct
  misc_feature 1..12: note = Description of Artificial Sequence: Synthetic oligonucleotide
  source 1..12: mol_type = other DNA
gctagacactac

SEQ ID NO: 927 - DNA, 12 bp, synthetic construct
  misc_feature 1..12: note = Description of Artificial Sequence: Synthetic oligonucleotide
  source 1..12: mol_type = other DNA
tcacttggtgcg

SEQ ID NO: 928 - DNA, 12 bp, synthetic construct
  misc_feature 1..12: note = Description of Artificial Sequence: Synthetic oligonucleotide
  source 1..12: mol_type = other DNA
tgacctcaagac

SEQ ID NO: 929 - DNA, 12 bp, synthetic construct
  misc_feature 1..12: note = Description of Artificial Sequence: Synthetic oligonucleotide
  source 1..12: mol_type = other DNA
ctaccttgagga

SEQ ID NO: 930 - DNA, 12 bp, synthetic construct
  misc_feature 1..12: note = Description of Artificial Sequence: Synthetic oligonucleotide
  source 1..12: mol_type = other DNA
caaccgagatta

SEQ ID NO: 931 - DNA, 12 bp, synthetic construct
  misc_feature 1..12: note = Description of Artificial Sequence: Synthetic oligonucleotide
  source 1..12: mol_type = other DNA
agattgaccaac

SEQ ID NO: 932 - DNA, 12 bp, synthetic construct
  misc_feature 1..12: note = Description of Artificial Sequence: Synthetic oligonucleotide
  source 1..12: mol_type = other DNA
ttggattgaacg

SEQ ID NO: 933 - DNA, 12 bp, synthetic construct
  misc_feature 1..12: note = Description of Artificial Sequence: Synthetic oligonucleotide
  source 1..12: mol_type = other DNA
ttatgtacggcg

SEQ ID NO: 934 - DNA, 12 bp, synthetic construct
  misc_feature 1..12: note = Description of Artificial Sequence: Synthetic oligonucleotide
  source 1..12: mol_type = other DNA
gccaaatcgctc

SEQ ID NO: 935 - DNA, 12 bp, synthetic construct
  misc_feature 1..12: note = Description of Artificial Sequence: Synthetic oligonucleotide
  source 1..12: mol_type = other DNA
cgtgttatgtgg

SEQ ID NO: 936 - DNA, 12 bp, synthetic construct
  misc_feature 1..12: note = Description of Artificial Sequence: Synthetic oligonucleotide
  source 1..12: mol_type = other DNA
gattcgagtgtc

SEQ ID NO: 937 - DNA, 12 bp, synthetic construct
  misc_feature 1..12: note = Description of Artificial Sequence: Synthetic oligonucleotide
  source 1..12: mol_type = other DNA
agttacgagcta

SEQ ID NO: 938 - DNA, 12 bp, synthetic construct
  misc_feature 1..12: note = Description of Artificial Sequence: Synthetic oligonucleotide
  source 1..12: mol_type = other DNA
gatataccagtg

SEQ ID NO: 939 - DNA, 12 bp, synthetic construct
  misc_feature 1..12: note = Description of Artificial Sequence: Synthetic oligonucleotide
  source 1..12: mol_type = other DNA
ttggacgtccac

SEQ ID NO: 940 - DNA, 12 bp, synthetic construct
  misc_feature 1..12: note = Description of Artificial Sequence: Synthetic oligonucleotide
  source 1..12: mol_type = other DNA
tcaaagctcaag

SEQ ID NO: 941 - DNA, 12 bp, synthetic construct
  misc_feature 1..12: note = Description of Artificial Sequence: Synthetic oligonucleotide
  source 1..12: mol_type = other DNA
gtacgcacagtt

SEQ ID NO: 942 - DNA, 12 bp, synthetic construct
  misc_feature 1..12: note = Description of Artificial Sequence: Synthetic oligonucleotide
  source 1..12: mol_type = other DNA
ggtaacctctga

SEQ ID NO: 943 - DNA, 12 bp, synthetic construct
  misc_feature 1..12: note = Description of Artificial Sequence: Synthetic oligonucleotide
  source 1..12: mol_type = other DNA
gcatatgcactg

SEQ ID NO: 944 - DNA, 12 bp, synthetic construct
  misc_feature 1..12: note = Description of Artificial Sequence: Synthetic oligonucleotide
  source 1..12: mol_type = other DNA
aacaaactgcca

SEQ ID NO: 945 - DNA, 12 bp, synthetic construct
  misc_feature 1..12: note = Description of Artificial Sequence: Synthetic oligonucleotide
  source 1..12: mol_type = other DNA
tccagggctata

SEQ ID NO: 946 - DNA, 12 bp, synthetic construct
  misc_feature 1..12: note = Description of Artificial Sequence: Synthetic oligonucleotide
  source 1..12: mol_type = other DNA
taccaatcggtg

SEQ ID NO: 947 - DNA, 12 bp, synthetic construct
  misc_feature 1..12: note = Description of Artificial Sequence: Synthetic oligonucleotide
  source 1..12: mol_type = other DNA
tggactcagcta

SEQ ID NO: 948 - DNA, 12 bp, synthetic construct
  misc_feature 1..12: note = Description of Artificial Sequence: Synthetic oligonucleotide
  source 1..12: mol_type = other DNA
agcgaacctgtt

SEQ ID NO: 949 - DNA, 12 bp, synthetic construct
  misc_feature 1..12: note = Description of Artificial Sequence: Synthetic oligonucleotide
  source 1..12: mol_type = other DNA
caactcccgtga

SEQ ID NO: 950 - DNA, 12 bp, synthetic construct
  misc_feature 1..12: note = Description of Artificial Sequence: Synthetic oligonucleotide
  source 1..12: mol_type = other DNA
gtagacatgtgt

SEQ ID NO: 951 - DNA, 12 bp, synthetic construct
  misc_feature 1..12: note = Description of Artificial Sequence: Synthetic oligonucleotide
  source 1..12: mol_type = other DNA
gcgtagagagac

SEQ ID NO: 952 - DNA, 12 bp, synthetic construct
  misc_feature 1..12: note = Description of Artificial Sequence: Synthetic oligonucleotide
  source 1..12: mol_type = other DNA
gtactcgaacca

SEQ ID NO: 953 - DNA, 12 bp, synthetic construct
  misc_feature 1..12: note = Description of Artificial Sequence: Synthetic oligonucleotide
  source 1..12: mol_type = other DNA
acgcgctaaatc

SEQ ID NO: 954 - DNA, 12 bp, synthetic construct
  misc_feature 1..12: note = Description of Artificial Sequence: Synthetic oligonucleotide
  source 1..12: mol_type = other DNA
acatgcacatgc

SEQ ID NO: 955 - DNA, 12 bp, synthetic construct
  misc_feature 1..12: note = Description of Artificial Sequence: Synthetic oligonucleotide
  source 1..12: mol_type = other DNA
ttgcgttagcag

SEQ ID NO: 956 - DNA, 12 bp, synthetic construct
  misc_feature 1..12: note = Description of Artificial Sequence: Synthetic oligonucleotide
  source 1..12: mol_type = other DNA
tacagttacgcg

SEQ ID NO: 957 - DNA, 12 bp, synthetic construct
  misc_feature 1..12: note = Description of Artificial Sequence: Synthetic oligonucleotide
  source 1..12: mol_type = other DNA
gaaactcctaga

SEQ ID NO: 958 - DNA, 12 bp, synthetic construct
  misc_feature 1..12: note = Description of Artificial Sequence: Synthetic oligonucleotide
  source 1..12: mol_type = other DNA
ttccggcgattg

SEQ ID NO: 959 - DNA, 12 bp, synthetic construct
  misc_feature 1..12: note = Description of Artificial Sequence: Synthetic oligonucleotide
  source 1..12: mol_type = other DNA
gacctgaataca

SEQ ID NO: 960 - DNA, 12 bp, synthetic construct
  misc_feature 1..12: note = Description of Artificial Sequence: Synthetic oligonucleotide
  source 1..12: mol_type = other DNA
ccttacctcctc

SEQ ID NO: 961 - DNA, 12 bp, synthetic construct
  misc_feature 1..12: note = Description of Artificial Sequence: Synthetic oligonucleotide
  source 1..12: mol_type = other DNA
tacgagccctaa

SEQ ID NO: 962 - DNA, 12 bp, synthetic construct
  misc_feature 1..12: note = Description of Artificial Sequence: Synthetic oligonucleotide
  source 1..12: mol_type = other DNA
caagccctagta

SEQ ID NO: 963 - DNA, 12 bp, synthetic construct
  misc_feature 1..12: note = Description of Artificial Sequence: Synthetic oligonucleotide
  source 1..12: mol_type = other DNA
atcgggcttaac

SEQ ID NO: 964 - DNA, 12 bp, synthetic construct
  misc_feature 1..12: note = Description of Artificial Sequence: Synthetic oligonucleotide
  source 1..12: mol_type = other DNA
gacatgcggaga

SEQ ID NO: 965 - DNA, 12 bp, synthetic construct
  misc_feature 1..12: note = Description of Artificial Sequence: Synthetic oligonucleotide
  source 1..12: mol_type = other DNA
acgtttgtggca

SEQ ID NO: 966 - DNA, 12 bp, synthetic construct
  misc_feature 1..12: note = Description of Artificial Sequence: Synthetic oligonucleotide
  source 1..12: mol_type = other DNA
acactggtcctg

SEQ ID NO: 967 - DNA, 12 bp, synthetic construct
  misc_feature 1..12: note = Description of Artificial Sequence: Synthetic oligonucleotide
  source 1..12: mol_type = other DNA
cactacgctaga

SEQ ID NO: 968 - DNA, 12 bp, synthetic construct
  misc_feature 1..12: note = Description of Artificial Sequence: Synthetic oligonucleotide
  source 1..12: mol_type = other DNA
tagtgtcggatc

SEQ ID NO: 969 - DNA, 12 bp, synthetic construct
  misc_feature 1..12: note = Description of Artificial Sequence: Synthetic oligonucleotide
  source 1..12: mol_type = other DNA
tacgcccatcag

SEQ ID NO: 970 - DNA, 12 bp, synthetic construct
  misc_feature 1..12: note = Description of Artificial Sequence: Synthetic oligonucleotide
  source 1..12: mol_type = other DNA
cgcacccataca

SEQ ID NO: 971 - DNA, 12 bp, synthetic construct
  misc_feature 1..12: note = Description of Artificial Sequence: Synthetic oligonucleotide
  source 1..12: mol_type = other DNA
gcttaacgtgcc

SEQ ID NO: 972 - DNA, 12 bp, synthetic construct
  misc_feature 1..12: note = Description of Artificial Sequence: Synthetic oligonucleotide
  source 1..12: mol_type = other DNA
agcttgaatcag

SEQ ID NO: 973 - DNA, 12 bp, synthetic construct
  misc_feature 1..12: note = Description of Artificial Sequence: Synthetic oligonucleotide
  source 1..12: mol_type = other DNA
tgcagtcctcga

SEQ ID NO: 974 - DNA, 12 bp, synthetic construct
  misc_feature 1..12: note = Description of Artificial Sequence: Synthetic oligonucleotide
  source 1..12: mol_type = other DNA
ctgagctctgca

SEQ ID NO: 975 - DNA, 12 bp, synthetic construct
  misc_feature 1..12: note = Description of Artificial Sequence: Synthetic oligonucleotide
  source 1..12: mol_type = other DNA
aagatcgtactg

SEQ ID NO: 976 - DNA, 12 bp, synthetic construct
  misc_feature 1..12: note = Description of Artificial Sequence: Synthetic oligonucleotide
  source 1..12: mol_type = other DNA
acattgaagcgt

SEQ ID NO: 977 - DNA, 12 bp, synthetic construct
  misc_feature 1..12: note = Description of Artificial Sequence: Synthetic oligonucleotide
  source 1..12: mol_type = other DNA
gaatggatgggc

SEQ ID NO: 978 - DNA, 12 bp, synthetic construct
  misc_feature 1..12: note = Description of Artificial Sequence: Synthetic oligonucleotide
  source 1..12: mol_type = other DNA
taaagcgaggag

SEQ ID NO: 979 - DNA, 12 bp, synthetic construct
  misc_feature 1..12: note = Description of Artificial Sequence: Synthetic oligonucleotide
  source 1..12: mol_type = other DNA
accatagctccg

SEQ ID NO: 980 - DNA, 12 bp, synthetic construct
  misc_feature 1..12: note = Description of Artificial Sequence: Synthetic oligonucleotide
  source 1..12: mol_type = other DNA
cttcgactttcc

SEQ ID NO: 981 - DNA, 12 bp, synthetic construct
  misc_feature 1..12: note = Description of Artificial Sequence: Synthetic oligonucleotide
  source 1..12: mol_type = other DNA
actcatcttcca

SEQ ID NO: 982 - DNA, 12 bp, synthetic construct
  misc_feature 1..12: note = Description of Artificial Sequence: Synthetic oligonucleotide
  source 1..12: mol_type = other DNA
gacgacatttag

SEQ ID NO: 983 - DNA, 12 bp, synthetic construct
  misc_feature 1..12: note = Description of Artificial Sequence: Synthetic oligonucleotide
  source 1..12: mol_type = other DNA
catgaacagtgt

SEQ ID NO: 984 - DNA, 12 bp, synthetic construct
  misc_feature 1..12: note = Description of Artificial Sequence: Synthetic oligonucleotide
  source 1..12: mol_type = other DNA
cgacaacttgtg

SEQ ID NO: 985 - DNA, 12 bp, synthetic construct
  misc_feature 1..12: note = Description of Artificial Sequence: Synthetic oligonucleotide
  source 1..12: mol_type = other DNA
tcgacatctctt

SEQ ID NO: 986 - DNA, 12 bp, synthetic construct
  misc_feature 1..12: note = Description of Artificial Sequence: Synthetic oligonucleotide
  source 1..12: mol_type = other DNA
gtcataagaacc

SEQ ID NO: 987 - DNA, 12 bp, synthetic construct
  misc_feature 1..12: note = Description of Artificial Sequence: Synthetic oligonucleotide
  source 1..12: mol_type = other DNA
gagatacagttc

SEQ ID NO: 988 - DNA, 12 bp, synthetic construct
  misc_feature 1..12: note = Description of Artificial Sequence: Synthetic oligonucleotide
  source 1..12: mol_type = other DNA
ccaactactcgg

SEQ ID NO: 989 - DNA, 12 bp, synthetic construct
  misc_feature 1..12: note = Description of Artificial Sequence: Synthetic oligonucleotide
  source 1..12: mol_type = other DNA
gactagtcagct

SEQ ID NO: 990 - DNA, 12 bp, synthetic construct
  misc_feature 1..12: note = Description of Artificial Sequence: Synthetic oligonucleotide
  source 1..12: mol_type = other DNA
cgctggctttag

SEQ ID NO: 991 - DNA, 12 bp, synthetic construct
  misc_feature 1..12: note = Description of Artificial Sequence: Synthetic oligonucleotide
  source 1..12: mol_type = other DNA
gaacactttgga

SEQ ID NO: 992 - DNA, 12 bp, synthetic construct
  misc_feature 1..12: note = Description of Artificial Sequence: Synthetic oligonucleotide
  source 1..12: mol_type = other DNA
gtccgcaagtta

SEQ ID NO: 993 - DNA, 12 bp, synthetic construct
  misc_feature 1..12: note = Description of Artificial Sequence: Synthetic oligonucleotide
  source 1..12: mol_type = other DNA
gcatgcatccca

SEQ ID NO: 994 - DNA, 12 bp, synthetic construct
  misc_feature 1..12: note = Description of Artificial Sequence: Synthetic oligonucleotide
  source 1..12: mol_type = other DNA
ccgttatcagcg

SEQ ID NO: 995 - DNA, 12 bp, synthetic construct
  misc_feature 1..12: note = Description of Artificial Sequence: Synthetic oligonucleotide
  source 1..12: mol_type = other DNA
caagaaattcgc

SEQ ID NO: 996 - DNA, 12 bp, synthetic construct
  misc_feature 1..12: note = Description of Artificial Sequence: Synthetic oligonucleotide
  source 1..12: mol_type = other DNA
gtgatacccgct

SEQ ID NO: 997 - DNA, 12 bp, synthetic construct
  misc_feature 1..12: note = Description of Artificial Sequence: Synthetic oligonucleotide
  source 1..12: mol_type = other DNA
gagccatctgta

SEQ ID NO: 998 - DNA, 12 bp, synthetic construct
  misc_feature 1..12: note = Description of Artificial Sequence: Synthetic oligonucleotide
  source 1..12: mol_type = other DNA
cgtagagctctc

SEQ ID NO: 999 - DNA, 12 bp, synthetic construct
  misc_feature 1..12: note = Description of Artificial Sequence: Synthetic oligonucleotide
  source 1..12: mol_type = other DNA
gatctaatcgag

SEQ ID NO: 1000 - DNA, 12 bp, synthetic construct
  misc_feature 1..12: note = Description of Artificial Sequence: Synthetic oligonucleotide
  source 1..12: mol_type = other DNA
tatggccaaacc

SEQ ID NO: 1001 - DNA, 12 bp, synthetic construct
  misc_feature 1..12: note = Description of Artificial Sequence: Synthetic oligonucleotide
  source 1..12: mol_type = other DNA
aagctctcccag

SEQ ID NO: 1002 - DNA, 12 bp, synthetic construct
  misc_feature 1..12: note = Description of Artificial Sequence: Synthetic oligonucleotide
  source 1..12: mol_type = other DNA
ccagttccaaag

SEQ ID NO: 1003 - DNA, 12 bp, synthetic construct
  misc_feature 1..12: note = Description of Artificial Sequence: Synthetic oligonucleotide
  source 1..12: mol_type = other DNA
ttgggtacacgt

SEQ ID NO: 1004 - DNA, 12 bp, synthetic construct
  misc_feature 1..12: note = Description of Artificial Sequence: Synthetic oligonucleotide
  source 1..12: mol_type = other DNA
cctctgagagct

SEQ ID NO: 1005 - DNA, 12 bp, synthetic construct
  misc_feature 1..12: note = Description of Artificial Sequence: Synthetic oligonucleotide
  source 1..12: mol_type = other DNA
aatcttgcgccg

SEQ ID NO: 1006 - DNA, 12 bp, synthetic construct
  misc_feature 1..12: note = Description of Artificial Sequence: Synthetic oligonucleotide
  source 1..12: mol_type = other DNA
tgcctaagatcg

SEQ ID NO: 1007 - DNA, 12 bp, synthetic construct
  misc_feature 1..12: note = Description of Artificial Sequence: Synthetic oligonucleotide
  source 1..12: mol_type = other DNA
tggatctgtccg

SEQ ID NO: 1008 - DNA, 12 bp, synthetic construct
  misc_feature 1..12: note = Description of Artificial Sequence: Synthetic oligonucleotide
  source 1..12: mol_type = other DNA
gtctggattgaa

SEQ ID NO: 1009 - DNA, 12 bp, synthetic construct
  misc_feature 1..12: note = Description of Artificial Sequence: Synthetic oligonucleotide
  source 1..12: mol_type = other DNA
aaggcgctcctt

SEQ ID NO: 1010 - DNA, 12 bp, synthetic construct
  misc_feature 1..12: note = Description of Artificial Sequence: Synthetic oligonucleotide
  source 1..12: mol_type = other DNA
cctcgatgcagt

SEQ ID NO: 1011 - DNA, 12 bp, synthetic construct
  misc_feature 1..12: note = Description of Artificial Sequence: Synthetic oligonucleotide
  source 1..12: mol_type = other DNA
ggaaatcccatc

SEQ ID NO: 1012 - DNA, 12 bp, synthetic construct
  misc_feature 1..12: note = Description of Artificial Sequence: Synthetic oligonucleotide
  source 1..12: mol_type = other DNA
ttaactggaagc

SEQ ID NO: 1013 - DNA, 12 bp, synthetic construct
  misc_feature 1..12: note = Description of Artificial Sequence: Synthetic oligonucleotide
  source 1..12: mol_type = other DNA
cctactcggtga

SEQ ID NO: 1014 - DNA, 12 bp, synthetic construct
  misc_feature 1..12: note = Description of Artificial Sequence: Synthetic oligonucleotide
  source 1..12: mol_type = other DNA
gcgcaatagtat

SEQ ID NO: 1015 - DNA, 12 bp, synthetic construct
  misc_feature 1..12: note = Description of Artificial Sequence: Synthetic oligonucleotide
  source 1..12: mol_type = other DNA
taatacggatcg

SEQ ID NO: 1016 - DNA, 12 bp, synthetic construct
  misc_feature 1..12: note = Description of Artificial Sequence: Synthetic oligonucleotide
  source 1..12: mol_type = other DNA
gcggactattca

SEQ ID NO: 1017 - DNA, 12 bp, synthetic construct
  misc_feature 1..12: note = Description of Artificial Sequence: Synthetic oligonucleotide
  source 1..12: mol_type = other DNA
gaccgtcaatac

SEQ ID NO: 1018 - DNA, 12 bp, synthetic construct
  misc_feature 1..12: note = Description of Artificial Sequence: Synthetic oligonucleotide
  source 1..12: mol_type = other DNA
attcgagctgtg

SEQ ID NO: 1019 - DNA, 12 bp, synthetic construct
  misc_feature 1..12: note = Description of Artificial Sequence: Synthetic oligonucleotide
  source 1..12: mol_type = other DNA
ataccgtctttc

SEQ ID NO: 1020 - DNA, 12 bp, synthetic construct
  misc_feature 1..12: note = Description of Artificial Sequence: Synthetic oligonucleotide
  source 1..12: mol_type = other DNA
agcgttgtccaa

SEQ ID NO: 1021 - DNA, 12 bp, synthetic construct
  misc_feature 1..12: note = Description of Artificial Sequence: Synthetic oligonucleotide
  source 1..12: mol_type = other DNA
tcggaattagac

SEQ ID NO: 1022 - DNA, 12 bp, synthetic construct
  misc_feature 1..12: note = Description of Artificial Sequence: Synthetic oligonucleotide
  source 1..12: mol_type = other DNA
cgtgcacaattg

SEQ ID NO: 1023 - DNA, 12 bp, synthetic construct
  misc_feature 1..12: note = Description of Artificial Sequence: Synthetic oligonucleotide
  source 1..12: mol_type = other DNA
ttggaacggctt

SEQ ID NO: 1024 - DNA, 12 bp, synthetic construct
  misc_feature 1..12: note = Description of Artificial Sequence: Synthetic oligonucleotide
  source 1..12: mol_type = other DNA
ggtctgttgagt

SEQ ID NO: 1025 - DNA, 12 bp, synthetic construct
  misc_feature 1..12: note = Description of Artificial Sequence: Synthetic oligonucleotide
  source 1..12: mol_type = other DNA
aaggaccgtttc

SEQ ID NO: 1026 - DNA, 12 bp, synthetic construct
  misc_feature 1..12: note = Description of Artificial Sequence: Synthetic oligonucleotide
  source 1..12: mol_type = other DNA
cgcctaaaccgt

SEQ ID NO: 1027 - DNA, 12 bp, synthetic construct
  misc_feature 1..12: note = Description of Artificial Sequence: Synthetic oligonucleotide
  source 1..12: mol_type = other DNA
tgtgaattcgga

SEQ ID NO: 1028 - DNA, 12 bp, synthetic construct
  misc_feature 1..12: note = Description of Artificial Sequence: Synthetic oligonucleotide
  source 1..12: mol_type = other DNA
cggcctaagttc

SEQ ID NO: 1029 - DNA, 12 bp, synthetic construct
  misc_feature 1..12: note = Description of Artificial Sequence: Synthetic oligonucleotide
  source 1..12: mol_type = other DNA
tcctaggtccga

SEQ ID NO: 1030 - DNA, 12 bp, synthetic construct
  misc_feature 1..12: note = Description of Artificial Sequence: Synthetic oligonucleotide
  source 1..12: mol_type = other DNA
ctcgtcgactga

SEQ ID NO: 1031 - DNA, 12 bp, synthetic construct
  misc_feature 1..12: note = Description of Artificial Sequence: Synthetic oligonucleotide
  source 1..12: mol_type = other DNA
aagtaggaagga

SEQ ID NO: 1032 - DNA, 12 bp, synthetic construct
  misc_feature 1..12: note = Description of Artificial Sequence: Synthetic oligonucleotide
  source 1..12: mol_type = other DNA
aacaccatcgac

SEQ ID NO: 1033 - DNA, 12 bp, synthetic construct
  misc_feature 1..12: note = Description of Artificial Sequence: Synthetic oligonucleotide
  source 1..12: mol_type = other DNA
cattcgtggcgt

SEQ ID NO: 1034 - DNA, 12 bp, synthetic construct
  misc_feature 1..12: note = Description of Artificial Sequence: Synthetic oligonucleotide
  source 1..12: mol_type = other DNA
agcgctcacatc

SEQ ID NO: 1035 - DNA, 12 bp, synthetic construct
  misc_feature 1..12: note = Description of Artificial Sequence: Synthetic oligonucleotide
  source 1..12: mol_type = other DNA
tcctcactatca

SEQ ID NO: 1036 - DNA, 12 bp, synthetic construct
  misc_feature 1..12: note = Description of Artificial Sequence: Synthetic oligonucleotide
  source 1..12: mol_type = other DNA
tctttcataccg

SEQ ID NO: 1037 - DNA, 12 bp, synthetic construct
  misc_feature 1..12: note = Description of Artificial Sequence: Synthetic oligonucleotide
  source 1..12: mol_type = other DNA
cgtgccgcttaa

SEQ ID NO: 1038 - DNA, 12 bp, synthetic construct
  misc_feature 1..12: note = Description of Artificial Sequence: Synthetic oligonucleotide
  source 1..12: mol_type = other DNA
ctatagacacga

SEQ ID NO: 1039 - DNA, 12 bp, synthetic construct
  misc_feature 1..12: note = Description of Artificial Sequence: Synthetic oligonucleotide
  source 1..12: mol_type = other DNA
tactacgtggcc

SEQ ID NO: 1040 - DNA, 12 bp, synthetic construct
  misc_feature 1..12: note = Description of Artificial Sequence: Synthetic oligonucleotide
  source 1..12: mol_type = other DNA
tggttatggcac

SEQ ID NO: 1041 - DNA, 12 bp, synthetic construct
  misc_feature 1..12: note = Description of Artificial Sequence: Synthetic oligonucleotide
  source 1..12: mol_type = other DNA
gcctgcagtact

SEQ ID NO: 1042 - DNA, 12 bp, synthetic construct
  misc_feature 1..12: note = Description of Artificial Sequence: Synthetic oligonucleotide
  source 1..12: mol_type = other DNA
cattcccgaaag

SEQ ID NO: 1043 - DNA, 12 bp, synthetic construct
  misc_feature 1..12: note = Description of Artificial Sequence: Synthetic oligonucleotide
  source 1..12: mol_type = other DNA
gcgtcatgcatc

SEQ ID NO: 1044 - DNA, 12 bp, synthetic construct
  misc_feature 1..12: note = Description of Artificial Sequence: Synthetic oligonucleotide
  source 1..12: mol_type = other DNA
caagagcggatg

SEQ ID NO: 1045 - DNA, 12 bp, synthetic construct
  misc_feature 1..12: note = Description of Artificial Sequence: Synthetic oligonucleotide
  source 1..12: mol_type = other DNA
ggccagttccta

SEQ ID NO: 1046 - DNA, 12 bp, synthetic construct
  misc_feature 1..12: note = Description of Artificial Sequence: Synthetic oligonucleotide
  source 1..12: mol_type = other DNA
cgaggttctgat

SEQ ID NO: 1047 - DNA, 12 bp, synthetic construct
  misc_feature 1..12: note = Description of Artificial Sequence: Synthetic oligonucleotide
  source 1..12: mol_type = other DNA
gcccaagttcac

SEQ ID NO: 1048 - DNA, 12 bp, synthetic construct
  misc_feature 1..12: note = Description of Artificial Sequence: Synthetic oligonucleotide
  source 1..12: mol_type = other DNA
ttgtcagctgga

SEQ ID NO: 1049 - DNA, 12 bp, synthetic construct
  misc_feature 1..12: note = Description of Artificial Sequence: Synthetic oligonucleotide
  source 1..12: mol_type = other DNA
cgttggacaaat

SEQ ID NO: 1050 - DNA, 12 bp, synthetic construct
  misc_feature 1..12: note = Description of Artificial Sequence: Synthetic oligonucleotide
  source 1..12: mol_type = other DNA
cctttggctgag

SEQ ID NO: 1051 - DNA, 12 bp, synthetic construct
  misc_feature 1..12: note = Description of Artificial Sequence: Synthetic oligonucleotide
  source 1..12: mol_type = other DNA
gatgttcgctag

SEQ ID NO: 1052 - DNA, 12 bp, synthetic construct
  misc_feature 1..12: note = Description of Artificial Sequence: Synthetic oligonucleotide
  source 1..12: mol_type = other DNA
aactcctgtgga

SEQ ID NO: 1053 - DNA, 12 bp, synthetic construct
  misc_feature 1..12: note = Description of Artificial Sequence: Synthetic oligonucleotide
  source 1..12: mol_type = other DNA
ataaagaggagg

SEQ ID NO: 1054 - DNA, 12 bp, synthetic construct
  misc_feature 1..12: note = Description of Artificial Sequence: Synthetic oligonucleotide
  source 1..12: mol_type = other DNA
atctgcgcacca

SEQ ID NO: 1055 - DNA, 12 bp, synthetic construct
  misc_feature 1..12: note = Description of Artificial Sequence: Synthetic oligonucleotide
  source 1..12: mol_type = other DNA
ttgttgatggag

SEQ ID NO: 1056 - DNA, 12 bp, synthetic construct
  misc_feature 1..12: note = Description of Artificial Sequence: Synthetic oligonucleotide
  source 1..12: mol_type = other DNA
cgacccatacgt

SEQ ID NO: 1057 - DNA, 12 bp, synthetic construct
  misc_feature 1..12: note = Description of Artificial Sequence: Synthetic oligonucleotide
  source 1..12: mol_type = other DNA
ctatctcctgtc

SEQ ID NO: 1058 - DNA, 12 bp, synthetic construct
  misc_feature 1..12: note = Description of Artificial Sequence: Synthetic oligonucleotide
  source 1..12: mol_type = other DNA
taatggtcgtag

SEQ ID NO: 1059 - DNA, 12 bp, synthetic construct
  misc_feature 1..12: note = Description of Artificial Sequence: Synthetic oligonucleotide
  source 1..12: mol_type = other DNA
gcgccgaatctt

SEQ ID NO: 1060 - DNA, 12 bp, synthetic construct
  misc_feature 1..12: note = Description of Artificial Sequence: Synthetic oligonucleotide
  source 1..12: mol_type = other DNA
ccacgtacgtaa

SEQ ID NO: 1061 - DNA, 12 bp, synthetic construct
  misc_feature 1..12: note = Description of Artificial Sequence: Synthetic oligonucleotide
  source 1..12: mol_type = other DNA
cttacactgctt

SEQ ID NO: 1062 - DNA, 12 bp, synthetic construct
  misc_feature 1..12: note = Description of Artificial Sequence: Synthetic oligonucleotide
  source 1..12: mol_type = other DNA
ctggattacggt

SEQ ID NO: 1063 - DNA, 12 bp, synthetic construct
  misc_feature 1..12: note = Description of Artificial Sequence: Synthetic oligonucleotide
  source 1..12: mol_type = other DNA
actcacaggaat

SEQ ID NO: 1064 - DNA, 12 bp, synthetic construct
  misc_feature 1..12: note = Description of Artificial Sequence: Synthetic oligonucleotide
  source 1..12: mol_type = other DNA
ttgcaccgtcga

SEQ ID NO: 1065 - DNA, 12 bp, synthetic construct
  misc_feature 1..12: note = Description of Artificial Sequence: Synthetic oligonucleotide
  source 1..12: mol_type = other DNA
atcccagcatgc

SEQ ID NO: 1066 - DNA, 12 bp, synthetic construct
  misc_feature 1..12: note = Description of Artificial Sequence: Synthetic oligonucleotide
  source 1..12: mol_type = other DNA
acgatatggtca

SEQ ID NO: 1067 - DNA, 12 bp, synthetic construct
  misc_feature 1..12: note = Description of Artificial Sequence: Synthetic oligonucleotide
  source 1..12: mol_type = other DNA
aatgcgcgtata

SEQ ID NO: 1068 - DNA, 12 bp, synthetic construct
  misc_feature 1..12: note = Description of Artificial Sequence: Synthetic oligonucleotide
  source 1..12: mol_type = other DNA
accacacgtagt

SEQ ID NO: 1069 - DNA, 12 bp, synthetic construct
  misc_feature 1..12: note = Description of Artificial Sequence: Synthetic oligonucleotide
  source 1..12: mol_type = other DNA
atgatgagcctc

SEQ ID NO: 1070 - DNA, 12 bp, synthetic construct
  misc_feature 1..12: note = Description of Artificial Sequence: Synthetic oligonucleotide
  source 1..12: mol_type = other DNA
tgctacagacgt

SEQ ID NO: 1071 - DNA, 12 bp, synthetic construct
  misc_feature 1..12: note = Description of Artificial Sequence: Synthetic oligonucleotide
  source 1..12: mol_type = other DNA
gcttccagacaa

SEQ ID NO: 1072 - DNA, 12 bp, synthetic construct
  misc_feature 1..12: note = Description of Artificial Sequence: Synthetic oligonucleotide
  source 1..12: mol_type = other DNA
gagacagtggaa

SEQ ID NO: 1073 - DNA, 12 bp, synthetic construct
  misc_feature 1..12: note = Description of Artificial Sequence: Synthetic oligonucleotide
  source 1..12: mol_type = other DNA
tgccattagagc

SEQ ID NO: 1074 - DNA, 12 bp, synthetic construct
  misc_feature 1..12: note = Description of Artificial Sequence: Synthetic oligonucleotide
  source 1..12: mol_type = other DNA
ctagtgacctag

SEQ ID NO: 1075 - DNA, 12 bp, synthetic construct
  misc_feature 1..12: note = Description of Artificial Sequence: Synthetic oligonucleotide
  source 1..12: mol_type = other DNA
gtcgacagagga

SEQ ID NO: 1076 - DNA, 12 bp, synthetic construct
  misc_feature 1..12: note = Description of Artificial Sequence: Synthetic oligonucleotide
  source 1..12: mol_type = other DNA
atggcctgacta

SEQ ID NO: 1077 - DNA, 12 bp, synthetic construct
  misc_feature 1..12: note = Description of Artificial Sequence: Synthetic oligonucleotide
  source 1..12: mol_type = other DNA
acacagtcctga

SEQ ID NO: 1078 - DNA, 12 bp, synthetic construct
  misc_feature 1..12: note = Description of Artificial Sequence: Synthetic oligonucleotide
  source 1..12: mol_type = other DNA
tcgtagtaatgg

SEQ ID NO: 1079 - DNA, 12 bp, synthetic construct
  misc_feature 1..12: note = Description of Artificial Sequence: Synthetic oligonucleotide
  source 1..12: mol_type = other DNA
cgaagggttgga

SEQ ID NO: 1080 - DNA, 12 bp, synthetic construct
  misc_feature 1..12: note = Description of Artificial Sequence: Synthetic oligonucleotide
  source 1..12: mol_type = other DNA
ggattcgtgtcc

SEQ ID NO: 1081 - DNA, 12 bp, synthetic construct
  misc_feature 1..12: note = Description of Artificial Sequence: Synthetic oligonucleotide
  source 1..12: mol_type = other DNA
tgtcgcaaatag

SEQ ID NO: 1082 - DNA, 12 bp, synthetic construct
  misc_feature 1..12: note = Description of Artificial Sequence: Synthetic oligonucleotide
  source 1..12: mol_type = other DNA
acgcacatacaa

SEQ ID NO: 1083 - DNA, 12 bp, synthetic construct
  misc_feature 1..12: note = Description of Artificial Sequence: Synthetic oligonucleotide
  source 1..12: mol_type = other DNA
attatacggcgc

SEQ ID NO: 1084 - DNA, 12 bp, synthetic construct
  misc_feature 1..12: note = Description of Artificial Sequence: Synthetic oligonucleotide
  source 1..12: mol_type = other DNA
aggctgtactcc

SEQ ID NO: 1085 - DNA, 12 bp, synthetic construct
  misc_feature 1..12: note = Description of Artificial Sequence: Synthetic oligonucleotide
  source 1..12: mol_type = other DNA
gagcaacatcct

SEQ ID NO: 1086 - DNA, 12 bp, synthetic construct
  misc_feature 1..12: note = Description of Artificial Sequence: Synthetic oligonucleotide
  source 1..12: mol_type = other DNA
gtgagataccta

SEQ ID NO: 1087 - DNA, 12 bp, synthetic construct
  misc_feature 1..12: note = Description of Artificial Sequence: Synthetic oligonucleotide
  source 1..12: mol_type = other DNA
catccctctact

SEQ ID NO: 1088 - DNA, 12 bp, synthetic construct
  misc_feature 1..12: note = Description of Artificial Sequence: Synthetic oligonucleotide
  source 1..12: mol_type = other DNA
tgagtggtctgt

SEQ ID NO: 1089 - DNA, 12 bp, synthetic construct
  misc_feature 1..12: note = Description of Artificial Sequence: Synthetic oligonucleotide
  source 1..12: mol_type = other DNA
attcagatggca

SEQ ID NO: 1090 - DNA, 12 bp, synthetic construct
  misc_feature 1..12: note = Description of Artificial Sequence: Synthetic oligonucleotide
  source 1..12: mol_type = other DNA
cggaagagaaca

SEQ ID NO: 1091 - DNA, 12 bp, synthetic construct
  misc_feature 1..12: note = Description of Artificial Sequence: Synthetic oligonucleotide
  source 1..12: mol_type = other DNA
tcgtgttgtggc

SEQ ID NO: 1092 - DNA, 12 bp, synthetic construct
  misc_feature 1..12: note = Description of Artificial Sequence: Synthetic oligonucleotide
  source 1..12: mol_type = other DNA
cgcggttactaa

SEQ ID NO: 1093 - DNA, 12 bp, synthetic construct
  misc_feature 1..12: note = Description of Artificial Sequence: Synthetic oligonucleotide
  source 1..12: mol_type = other DNA
tataccgctgcg

SEQ ID NO: 1094 - DNA, 12 bp, synthetic construct
  misc_feature 1..12: note = Description of Artificial Sequence: Synthetic oligonucleotide
  source 1..12: mol_type = other DNA
gatagcactcgt

SEQ ID NO: 1095 - DNA, 12 bp, synthetic construct
  misc_feature 1..12: note = Description of Artificial Sequence: Synthetic oligonucleotide
  source 1..12: mol_type = other DNA
taaacgcgactc

SEQ ID NO: 1096 - DNA, 12 bp, synthetic construct
  misc_feature 1..12: note = Description of Artificial Sequence: Synthetic oligonucleotide
  source 1..12: mol_type = other DNA
ctgcggatatac

SEQ ID NO: 1097 - DNA, 12 bp, synthetic construct
  misc_feature 1..12: note = Description of Artificial Sequence: Synthetic oligonucleotide
  source 1..12: mol_type = other DNA
atttcgacccgg

SEQ ID NO: 1098 - DNA, 12 bp, synthetic construct
  misc_feature 1..12: note = Description of Artificial Sequence: Synthetic oligonucleotide
  source 1..12: mol_type = other DNA
aggcccgtttac

SEQ ID NO: 1099 - DNA, 12 bp, synthetic construct
  misc_feature 1..12: note = Description of Artificial Sequence: Synthetic oligonucleotide
  source 1..12: mol_type = other DNA
agttgaggcatt

SEQ ID NO: 1100 - DNA, 12 bp, synthetic construct
  misc_feature 1..12: note = Description of Artificial Sequence: Synthetic oligonucleotide
  source 1..12: mol_type = other DNA
tagcgcgaactt

SEQ ID NO: 1101 - DNA, 12 bp, synthetic construct
  misc_feature 1..12: note = Description of Artificial Sequence: Synthetic oligonucleotide
  source 1..12: mol_type = other DNA
cctcgggtacta

SEQ ID NO: 1102 - DNA, 12 bp, synthetic construct
  misc_feature 1..12: note = Description of Artificial Sequence: Synthetic oligonucleotide
  source 1..12: mol_type = other DNA
ctagcgtgcgtt

SEQ ID NO: 1103 - DNA, 12 bp, synthetic construct
  misc_feature 1..12: note = Description of Artificial Sequence: Synthetic oligonucleotide
  source 1..12: mol_type = other DNA
tggattgtgaac

SEQ ID NO: 1104 - DNA, 12 bp, synthetic construct
  misc_feature 1..12: note = Description of Artificial Sequence: Synthetic oligonucleotide
  source 1..12: mol_type = other DNA
tgttgttgggaa

SEQ ID NO: 1105 - DNA, 12 bp, synthetic construct
  misc_feature 1..12: note = Description of Artificial Sequence: Synthetic oligonucleotide
  source 1..12: mol_type = other DNA
acaatagacacc

SEQ ID NO: 1106 - DNA, 12 bp, synthetic construct
  misc_feature 1..12: note = Description of Artificial Sequence: Synthetic oligonucleotide
  source 1..12: mol_type = other DNA
catacacgcacc

SEQ ID NO: 1107 - DNA, 12 bp, synthetic construct
  misc_feature 1..12: note = Description of Artificial Sequence: Synthetic oligonucleotide
  source 1..12: mol_type = other DNA
ttcacctgtatc

SEQ ID NO: 1108 - DNA, 12 bp, synthetic construct
  misc_feature 1..12: note = Description of Artificial Sequence: Synthetic oligonucleotide
  source 1..12: mol_type = other DNA
accatgtagaac

SEQ ID NO: 1109 - DNA, 12 bp, synthetic construct
  misc_feature 1..12: note = Description of Artificial Sequence: Synthetic oligonucleotide
  source 1..12: mol_type = other DNA
ccgttggactac

SEQ ID NO: 1110 - DNA, 12 bp, synthetic construct
  misc_feature 1..12: note = Description of Artificial Sequence: Synthetic oligonucleotide
  source 1..12: mol_type = other DNA
ctgaatctggtg

SEQ ID NO: 1111 - DNA, 12 bp, synthetic construct
  misc_feature 1..12: note = Description of Artificial Sequence: Synthetic oligonucleotide
  source 1..12: mol_type = other DNA
cggtcaattgac

SEQ ID NO: 1112 - DNA, 12 bp, synthetic construct
  misc_feature 1..12: note = Description of Artificial Sequence: Synthetic oligonucleotide
  source 1..12: mol_type = other DNA
acctcagtcaag

SEQ ID NO: 1113 - DNA, 12 bp, synthetic construct
  misc_feature 1..12: note = Description of Artificial Sequence: Synthetic oligonucleotide
  source 1..12: mol_type = other DNA
ctccaggtcatg

SEQ ID NO: 1114 - DNA, 12 bp, synthetic construct
  misc_feature 1..12: note = Description of Artificial Sequence: Synthetic oligonucleotide
  source 1..12: mol_type = other DNA
tagctcacagca

SEQ ID NO: 1115 - DNA, 12 bp, synthetic construct
  misc_feature 1..12: note = Description of Artificial Sequence: Synthetic oligonucleotide
  source 1..12: mol_type = other DNA
tctggctacgac

SEQ ID NO: 1116 - DNA, 12 bp, synthetic construct
  misc_feature 1..12: note = Description of Artificial Sequence: Synthetic oligonucleotide
  source 1..12: mol_type = other DNA
ggcctcactgat

SEQ ID NO: 1117 - DNA, 12 bp, synthetic construct
  misc_feature 1..12: note = Description of Artificial Sequence: Synthetic oligonucleotide
  source 1..12: mol_type = other DNA
gtggagtctcat

SEQ ID NO: 1118 - DNA, 12 bp, synthetic construct
  misc_feature 1..12: note = Description of Artificial Sequence: Synthetic oligonucleotide
  source 1..12: mol_type = other DNA
tcgaccaaacac

SEQ ID NO: 1119 - DNA, 12 bp, synthetic construct
  misc_feature 1..12: note = Description of Artificial Sequence: Synthetic oligonucleotide
  source 1..12: mol_type = other DNA
caggattcgtac

SEQ ID NO: 1120 - DNA, 12 bp, synthetic construct
  misc_feature 1..12: note = Description of Artificial Sequence: Synthetic oligonucleotide
  source 1..12: mol_type = other DNA
gtcttgggtcgt

SEQ ID NO: 1121 - DNA, 12 bp, synthetic construct
  misc_feature 1..12: note = Description of Artificial Sequence: Synthetic oligonucleotide
  source 1..12: mol_type = other DNA
tcaggcgtaaat

SEQ ID NO: 1122 - DNA, 12 bp, synthetic construct
  misc_feature 1..12: note = Description of Artificial Sequence: Synthetic oligonucleotide
  source 1..12: mol_type = other DNA
gtggttcgatgt

SEQ ID NO: 1123 - DNA, 12 bp, synthetic construct
  misc_feature 1..12: note = Description of Artificial Sequence: Synthetic oligonucleotide
  source 1..12: mol_type = other DNA
gctcgaagattc

SEQ ID NO: 1124 - DNA, 12 bp, synthetic construct
  misc_feature 1..12: note = Description of Artificial Sequence: Synthetic oligonucleotide
  source 1..12: mol_type = other DNA
ccacccagtaac

SEQ ID NO: 1125 - DNA, 12 bp, synthetic construct
  misc_feature 1..12: note = Description of Artificial Sequence: Synthetic oligonucleotide
  source 1..12: mol_type = other DNA
cgcatacgacct

SEQ ID NO: 1126 - DNA, 12 bp, synthetic construct
  misc_feature 1..12: note = Description of Artificial Sequence: Synthetic oligonucleotide
  source 1..12: mol_type = other DNA
ctgtatggagct

SEQ ID NO: 1127 - DNA, 12 bp, synthetic construct
  misc_feature 1..12: note = Description of Artificial Sequence: Synthetic oligonucleotide
  source 1..12: mol_type = other DNA
tcacggtgacat

SEQ ID NO: 1128 - DNA, 12 bp, synthetic construct
  misc_feature 1..12: note = Description of Artificial Sequence: Synthetic oligonucleotide
  source 1..12: mol_type = other DNA
tcgagagtttgc

SEQ ID NO: 1129 - DNA, 12 bp, synthetic construct
  misc_feature 1..12: note = Description of Artificial Sequence: Synthetic oligonucleotide
  source 1..12: mol_type = other DNA
aggcttacgtgt

SEQ ID NO: 1130 - DNA, 12 bp, synthetic construct
  misc_feature 1..12: note = Description of Artificial Sequence: Synthetic oligonucleotide
  source 1..12: mol_type = other DNA
atatcgcgatga

SEQ ID NO: 1131 - DNA, 12 bp, synthetic construct
  misc_feature 1..12: note = Description of Artificial Sequence: Synthetic oligonucleotide
  source 1..12: mol_type = other DNA
gcctcgtactga

SEQ ID NO: 1132 - DNA, 12 bp, synthetic construct
  misc_feature 1..12: note = Description of Artificial Sequence: Synthetic oligonucleotide
  source 1..12: mol_type = other DNA
atgcaactcgaa

SEQ ID NO: 1133 - DNA, 12 bp, synthetic construct
  misc_feature 1..12: note = Description of Artificial Sequence: Synthetic oligonucleotide
  source 1..12: mol_type = other DNA
caaggtcacctc

SEQ ID NO: 1134 - DNA, 12 bp, synthetic construct
  misc_feature 1..12: note = Description of Artificial Sequence: Synthetic oligonucleotide
  source 1..12: mol_type = other DNA
tacgactctggc

SEQ ID NO: 1135 - DNA, 12 bp, synthetic construct
  misc_feature 1..12: note = Description of Artificial Sequence: Synthetic oligonucleotide
  source 1..12: mol_type = other DNA
tctctaccactc

SEQ ID NO: 1136 - DNA, 12 bp, synthetic construct
  misc_feature 1..12: note = Description of Artificial Sequence: Synthetic oligonucleotide
  source 1..12: mol_type = other DNA
cgccggtaatct

SEQ ID NO: 1137 - DNA, 12 bp, synthetic construct
  misc_feature 1..12: note = Description of Artificial Sequence: Synthetic oligonucleotide
  source 1..12: mol_type = other DNA
accaacagattg

SEQ ID NO: 1138 - DNA, 12 bp, synthetic construct
  misc_feature 1..12: note = Description of Artificial Sequence: Synthetic oligonucleotide
  source 1..12: mol_type = other DNA
ctaactgacgca

SEQ ID NO: 1139 - DNA, 12 bp, synthetic construct
  misc_feature 1..12: note = Description of Artificial Sequence: Synthetic oligonucleotide
  source 1..12: mol_type = other DNA
ctatacgcgaac

SEQ ID NO: 1140 - DNA, 12 bp, synthetic construct
  misc_feature 1..12: note = Description of Artificial Sequence: Synthetic oligonucleotide
  source 1..12: mol_type = other DNA
gcgtaactctcg

SEQ ID NO: 1141 - DNA, 12 bp, synthetic construct
  misc_feature 1..12: note = Description of Artificial Sequence: Synthetic oligonucleotide
  source 1..12: mol_type = other DNA
acttccaacttc

SEQ ID NO: 1142 - DNA, 12 bp, synthetic construct
  misc_feature 1..12: note = Description of Artificial Sequence: Synthetic oligonucleotide
  source 1..12: mol_type = other DNA
ccgatgccttga

SEQ ID NO: 1143 - DNA, 12 bp, synthetic construct
  misc_feature 1..12: note = Description of Artificial Sequence: Synthetic oligonucleotide
  source 1..12: mol_type = other DNA
gtggcctactac

SEQ ID NO: 1144 - DNA, 12 bp, synthetic construct
  misc_feature 1..12: note = Description of Artificial Sequence: Synthetic oligonucleotide
  source 1..12: mol_type = other DNA
aacgtcctgtgc

SEQ ID NO: 1145 - DNA, 12 bp, synthetic construct
  misc_feature 1..12: note = Description of Artificial Sequence: Synthetic oligonucleotide
  source 1..12: mol_type = other DNA
gaggagtaaagc

SEQ ID NO: 1146 - DNA, 12 bp, synthetic construct
  misc_feature 1..12: note = Description of Artificial Sequence: Synthetic oligonucleotide
  source 1..12: mol_type = other DNA
ctttcccttcga

SEQ ID NO: 1147 - DNA, 12 bp, synthetic construct
  misc_feature 1..12: note = Description of Artificial Sequence: Synthetic oligonucleotide
  source 1..12: mol_type = other DNA
ctcacctaggaa

SEQ ID NO: 1148 - DNA, 12 bp, synthetic construct
  misc_feature 1..12: note = Description of Artificial Sequence: Synthetic oligonucleotide
  source 1..12: mol_type = other DNA
agcaggcacgaa

SEQ ID NO: 1149 - DNA, 12 bp, synthetic construct
  misc_feature 1..12: note = Description of Artificial Sequence: Synthetic oligonucleotide
  source 1..12: mol_type = other DNA
ttcccttctccg

SEQ ID NO: 1150 - DNA, 12 bp, synthetic construct
  misc_feature 1..12: note = Description of Artificial Sequence: Synthetic oligonucleotide
  source 1..12: mol_type = other DNA
agacgacgtgga

SEQ ID NO: 1151 - DNA, 12 bp, synthetic construct
  misc_feature 1..12: note = Description of Artificial Sequence: Synthetic oligonucleotide
  source 1..12: mol_type = other DNA
gcagcatgttaa

SEQ ID NO: 1152 - DNA, 12 bp, synthetic construct
  misc_feature 1..12: note = Description of Artificial Sequence: Synthetic oligonucleotide
  source 1..12: mol_type = other DNA
aagatttgcagc

SEQ ID NO: 1153 - DNA, 12 bp, synthetic construct
  misc_feature 1..12: note = Description of Artificial Sequence: Synthetic oligonucleotide
  source 1..12: mol_type = other DNA
gtgttgtcgtgc

SEQ ID NO: 1154 - DNA, 12 bp, synthetic construct
  misc_feature 1..12: note = Description of Artificial Sequence: Synthetic oligonucleotide
  source 1..12: mol_type = other DNA
tacgcagcacta

SEQ ID NO: 1155 - DNA, 12 bp, synthetic construct
  misc_feature 1..12: note = Description of Artificial Sequence: Synthetic oligonucleotide
  source 1..12: mol_type = other DNA
catttgacgacg

SEQ ID NO: 1156 - DNA, 12 bp, synthetic construct
  misc_feature 1..12: note = Description of Artificial Sequence: Synthetic oligonucleotide
  source 1..12: mol_type = other DNA
aaggttccgata

SEQ ID NO: 1157 - DNA, 12 bp, synthetic construct
  misc_feature 1..12: note = Description of Artificial Sequence: Synthetic oligonucleotide
  source 1..12: mol_type = other DNA
gttgggatcctc

SEQ ID NO: 1158 - DNA, 12 bp, synthetic construct
  misc_feature 1..12: note = Description of Artificial Sequence: Synthetic oligonucleotide
  source 1..12: mol_type = other DNA
aacggctggaag

SEQ ID NO: 1159 - DNA, 12 bp, synthetic construct
  misc_feature 1..12: note = Description of Artificial Sequence: Synthetic oligonucleotide
  source 1..12: mol_type = other DNA
ccacagatcgat

SEQ ID NO: 1160 - DNA, 12 bp, synthetic construct
  misc_feature 1..12: note = Description of Artificial Sequence: Synthetic oligonucleotide
  source 1..12: mol_type = other DNA
cgcttagtgctg

SEQ ID NO: 1161 - DNA, 12 bp, synthetic construct
  misc_feature 1..12: note = Description of Artificial Sequence: Synthetic oligonucleotide
  source 1..12: mol_type = other DNA
aagtgaagcgag

SEQ ID NO: 1162 - DNA, 12 bp, synthetic construct
  misc_feature 1..12: note = Description of Artificial Sequence: Synthetic oligonucleotide
  source 1..12: mol_type = other DNA
agtttctggtgg

SEQ ID NO: 1163 - DNA, 12 bp, synthetic construct
  misc_feature 1..12: note = Description of Artificial Sequence: Synthetic oligonucleotide
  source 1..12: mol_type = other DNA
ttcagcgatggt

SEQ ID NO: 1164 - DNA, 12 bp, synthetic construct
  misc_feature 1..12: note = Description of Artificial Sequence: Synthetic oligonucleotide
  source 1..12: mol_type = other DNA
atcgtccgcgat

SEQ ID NO: 1165 - DNA, 12 bp, synthetic construct
  misc_feature 1..12: note = Description of Artificial Sequence: Synthetic oligonucleotide
  source 1..12: mol_type = other DNA
tatcgacacaag

SEQ ID NO: 1166 - DNA, 12 bp, synthetic construct
  misc_feature 1..12: note = Description of Artificial Sequence: Synthetic oligonucleotide
  source 1..12: mol_type = other DNA
caaagtttgcga

SEQ ID NO: 1167 - DNA, 12 bp, synthetic construct
  misc_feature 1..12: note = Description of Artificial Sequence: Synthetic oligonucleotide
  source 1..12: mol_type = other DNA
tgccgccgtaat

SEQ ID NO: 1168 - DNA, 12 bp, synthetic construct
  misc_feature 1..12: note = Description of Artificial Sequence: Synthetic oligonucleotide
  source 1..12: mol_type = other DNA
ttcctcctgcta

SEQ ID NO: 1169 - DNA, 12 bp, synthetic construct
  misc_feature 1..12: note = Description of Artificial Sequence: Synthetic oligonucleotide
  source 1..12: mol_type = other DNA
acaatcccgagt

SEQ ID NO: 1170 - DNA, 12 bp, synthetic construct
  misc_feature 1..12: note = Description of Artificial Sequence: Synthetic oligonucleotide
  source 1..12: mol_type = other DNA
tcacagacaatg

SEQ ID NO: 1171 - DNA, 12 bp, synthetic construct
  misc_feature 1..12: note = Description of Artificial Sequence: Synthetic oligonucleotide
  source 1..12: mol_type = other DNA
gattccggctca

SEQ ID NO: 1172 - DNA, 12 bp, synthetic construct
  misc_feature 1..12: note = Description of Artificial Sequence: Synthetic oligonucleotide
  source 1..12: mol_type = other DNA
tcgagccgatct

SEQ ID NO: 1173 - DNA, 12 bp, synthetic construct
  misc_feature 1..12: note = Description of Artificial Sequence: Synthetic oligonucleotide
  source 1..12: mol_type = other DNA
aacctcggataa

SEQ ID NO: 1174 - DNA, 12 bp, synthetic construct
  misc_feature 1..12: note = Description of Artificial Sequence: Synthetic oligonucleotide
  source 1..12: mol_type = other DNA
catctcagtcgg

SEQ ID NO: 1175 - DNA, 12 bp, synthetic construct
  misc_feature 1..12: note = Description of Artificial Sequence: Synthetic oligonucleotide
  source 1..12: mol_type = other DNA
gttcttggagac

SEQ ID NO: 1176 - DNA, 12 bp, synthetic construct
  misc_feature 1..12: note = Description of Artificial Sequence: Synthetic oligonucleotide
  source 1..12: mol_type = other DNA
gagactatatgc

SEQ ID NO: 1177 - DNA, 12 bp, synthetic construct
  misc_feature 1..12: note = Description of Artificial Sequence: Synthetic oligonucleotide
  source 1..12: mol_type = other DNA
cgtaattgccgc

SEQ ID NO: 1178 - DNA, 12 bp, synthetic construct
  misc_feature 1..12: note = Description of Artificial Sequence: Synthetic oligonucleotide
  source 1..12: mol_type = other DNA
ctcatcatgttc

SEQ ID NO: 1179 - DNA, 12 bp, synthetic construct
  misc_feature 1..12: note = Description of Artificial Sequence: Synthetic oligonucleotide
  source 1..12: mol_type = other DNA
gtgcttgtgtag

SEQ ID NO: 1180 - DNA, 12 bp, synthetic construct
  misc_feature 1..12: note = Description of Artificial Sequence: Synthetic oligonucleotide
  source 1..12: mol_type = other DNA
atatgcgagact

SEQ ID NO: 1181 - DNA, 12 bp, synthetic construct
  misc_feature 1..12: note = Description of Artificial Sequence: Synthetic oligonucleotide
  source 1..12: mol_type = other DNA
tagccctgatgc

SEQ ID NO: 1182 - DNA, 12 bp, synthetic construct
  misc_feature 1..12: note = Description of Artificial Sequence: Synthetic oligonucleotide
  source 1..12: mol_type = other DNA
agagggtgatcg

SEQ ID NO: 1183 - DNA, 12 bp, synthetic construct
  misc_feature 1..12: note = Description of Artificial Sequence: Synthetic oligonucleotide
  source 1..12: mol_type = other DNA
ggtgactagttc

SEQ ID NO: 1184 - DNA, 12 bp, synthetic construct
  misc_feature 1..12: note = Description of Artificial Sequence: Synthetic oligonucleotide
  source 1..12: mol_type = other DNA
ccagggacttct

SEQ ID NO: 1185 - DNA, 12 bp, synthetic construct
  misc_feature 1..12: note = Description of Artificial Sequence: Synthetic oligonucleotide
  source 1..12: mol_type = other DNA
caactagactcg

SEQ ID NO: 1186 - DNA, 12 bp, synthetic construct
  misc_feature 1..12: note = Description of Artificial Sequence: Synthetic oligonucleotide
  source 1..12: mol_type = other DNA
gaccactgctgt

SEQ ID NO: 1187 - DNA, 12 bp, synthetic construct
  misc_feature 1..12: note = Description of Artificial Sequence: Synthetic oligonucleotide
  source 1..12: mol_type = other DNA
ttgtcccaagcg

SEQ ID NO: 1188 - DNA, 12 bp, synthetic construct
  misc_feature 1..12: note = Description of Artificial Sequence: Synthetic oligonucleotide
  source 1..12: mol_type = other DNA
tagagaatgctc

SEQ ID NO: 1189 - DNA, 12 bp, synthetic construct
  misc_feature 1..12: note = Description of Artificial Sequence: Synthetic oligonucleotide
  source 1..12: mol_type = other DNA
atgggttccgtc

SEQ ID NO: 1190 - DNA, 12 bp, synthetic construct
  misc_feature 1..12: note = Description of Artificial Sequence: Synthetic oligonucleotide
  source 1..12: mol_type = other DNA
gcaatccttgcg

SEQ ID NO: 1191 - DNA, 12 bp, synthetic construct
  misc_feature 1..12: note = Description of Artificial Sequence: Synthetic oligonucleotide
  source 1..12: mol_type = other DNA
agtgcccttggt

SEQ ID NO: 1192 - DNA, 12 bp, synthetic construct
  misc_feature 1..12: note = Description of Artificial Sequence: Synthetic oligonucleotide
  source 1..12: mol_type = other DNA
atagacactccg

SEQ ID NO: 1193 - DNA, 12 bp, synthetic construct
  misc_feature 1..12: note = Description of Artificial Sequence: Synthetic oligonucleotide
  source 1..12: mol_type = other DNA
ttcgtacttcgt

SEQ ID NO: 1194 - DNA, 12 bp, synthetic construct
  misc_feature 1..12: note = Description of Artificial Sequence: Synthetic oligonucleotide
  source 1..12: mol_type = other DNA
agagcatccact

SEQ ID NO: 1195 - DNA, 12 bp, synthetic construct
  misc_feature 1..12: note = Description of Artificial Sequence: Synthetic oligonucleotide
  source 1..12: mol_type = other DNA
taggcatgcttg

SEQ ID NO: 1196 - DNA, 12 bp, synthetic construct
  misc_feature 1..12: note = Description of Artificial Sequence: Synthetic oligonucleotide
  source 1..12: mol_type = other DNA
cctgcttccttc

SEQ ID NO: 1197 - DNA, 12 bp, synthetic construct
  misc_feature 1..12: note = Description of Artificial Sequence: Synthetic oligonucleotide
  source 1..12: mol_type = other DNA
ggaacgacgtga

SEQ ID NO: 1198 - DNA, 12 bp, synthetic construct
  misc_feature 1..12: note = Description of Artificial Sequence: Synthetic oligonucleotide
  source 1..12: mol_type = other DNA
gaatcgccgatt

SEQ ID NO: 1199 - DNA, 12 bp, synthetic construct
  misc_feature 1..12: note = Description of Artificial Sequence: Synthetic oligonucleotide
  source 1..12: mol_type = other DNA
ctgctcaggcat

SEQ ID NO: 1200 - DNA, 12 bp, synthetic construct
  misc_feature 1..12: note = Description of Artificial Sequence: Synthetic oligonucleotide
  source 1..12: mol_type = other DNA
acagtctgcatg

SEQ ID NO: 1201 - DNA, 12 bp, synthetic construct
  misc_feature 1..12: note = Description of Artificial Sequence: Synthetic oligonucleotide
  source 1..12: mol_type = other DNA
aactagttcagg

SEQ ID NO: 1202 - DNA, 12 bp, synthetic construct
  misc_feature 1..12: note = Description of Artificial Sequence: Synthetic oligonucleotide
  source 1..12: mol_type = other DNA
caaggcacaagg

SEQ ID NO: 1203 - DNA, 12 bp, synthetic construct
  misc_feature 1..12: note = Description of Artificial Sequence: Synthetic oligonucleotide
  source 1..12: mol_type = other DNA
tgtcagctgtcg

SEQ ID NO: 1204 - DNA, 12 bp, synthetic construct
  misc_feature 1..12: note = Description of Artificial Sequence: Synthetic oligonucleotide
  source 1..12: mol_type = other DNA
tagaaggctcct

SEQ ID NO: 1205 - DNA, 12 bp, synthetic construct
  misc_feature 1..12: note = Description of Artificial Sequence: Synthetic oligonucleotide
  source 1..12: mol_type = other DNA
gacatctgacac

SEQ ID NO: 1206 - DNA, 12 bp, synthetic construct
  misc_feature 1..12: note = Description of Artificial Sequence: Synthetic oligonucleotide
  source 1..12: mol_type = other DNA
aatcggtccgat

SEQ ID NO: 1207 - DNA, 12 bp, synthetic construct
  misc_feature 1..12: note = Description of Artificial Sequence: Synthetic oligonucleotide
  source 1..12: mol_type = other DNA
attctgccgaag

SEQ ID NO: 1208 - DNA, 12 bp, synthetic construct
  misc_feature 1..12: note = Description of Artificial Sequence: Synthetic oligonucleotide
  source 1..12: mol_type = other DNA
ggcctataagtc

SEQ ID NO: 1209 - DNA, 12 bp, synthetic construct
  misc_feature 1..12: note = Description of Artificial Sequence: Synthetic oligonucleotide
  source 1..12: mol_type = other DNA
ctggtgctgaat

SEQ ID NO: 1210 - DNA, 12 bp, synthetic construct
  misc_feature 1..12: note = Description of Artificial Sequence: Synthetic oligonucleotide
  source 1..12: mol_type = other DNA
cgactaactaga

SEQ ID NO: 1211 - DNA, 12 bp, synthetic construct
  misc_feature 1..12: note = Description of Artificial Sequence: Synthetic oligonucleotide
  source 1..12: mol_type = other DNA
cacaaccacaac

SEQ ID NO: 1212 - DNA, 12 bp, synthetic construct
  misc_feature 1..12: note = Description of Artificial Sequence: Synthetic oligonucleotide
  source 1..12: mol_type = other DNA
ccgttcaatgga

SEQ ID NO: 1213 - DNA, 12 bp, synthetic construct
  misc_feature 1..12: note = Description of Artificial Sequence: Synthetic oligonucleotide
  source 1..12: mol_type = other DNA
agcatgtcccgt

SEQ ID NO: 1214 - DNA, 12 bp, synthetic construct
  misc_feature 1..12: note = Description of Artificial Sequence: Synthetic oligonucleotide
  source 1..12: mol_type = other DNA
tccatttcatgc

SEQ ID NO: 1215 - DNA, 12 bp, synthetic construct
  misc_feature 1..12: note = Description of Artificial Sequence: Synthetic oligonucleotide
  source 1..12: mol_type = other DNA
gacagaggtgca

SEQ ID NO: 1216 - DNA, 12 bp, synthetic construct
  misc_feature 1..12: note = Description of Artificial Sequence: Synthetic oligonucleotide
  source 1..12: mol_type = other DNA
tacaaccgagta

SEQ ID NO: 1217 - DNA, 12 bp, synthetic construct
  misc_feature 1..12: note = Description of Artificial Sequence: Synthetic oligonucleotide
  source 1..12: mol_type = other DNA
gcaccaatctgc

SEQ ID NO: 1218 - DNA, 12 bp, synthetic construct
  misc_feature 1..12: note = Description of Artificial Sequence: Synthetic oligonucleotide
  source 1..12: mol_type = other DNA
ctctcggcgtaa

SEQ ID NO: 1219 - DNA, 12 bp, synthetic construct
  misc_feature 1..12: note = Description of Artificial Sequence: Synthetic oligonucleotide
  source 1..12: mol_type = other DNA
gtacgatatgac

SEQ ID NO: 1220 - DNA, 12 bp, synthetic construct
  misc_feature 1..12: note = Description of Artificial Sequence: Synthetic oligonucleotide
  source 1..12: mol_type = other DNA
tcggcgatcatc

SEQ ID NO: 1221 - DNA, 12 bp, synthetic construct
  misc_feature 1..12: note = Description of Artificial Sequence: Synthetic oligonucleotide
  source 1..12: mol_type = other DNA
tcagaccaactg

SEQ ID NO: 1222 - DNA, 12 bp, synthetic construct
  misc_feature 1..12: note = Description of Artificial Sequence: Synthetic oligonucleotide
  source 1..12: mol_type = other DNA
ctcatggtagca

SEQ ID NO: 1223 - DNA, 12 bp, synthetic construct
  misc_feature 1..12: note = Description of Artificial Sequence: Synthetic oligonucleotide
  source 1..12: mol_type = other DNA
attagcagcgta

SEQ ID NO: 1224 - DNA, 12 bp, synthetic construct
  misc_feature 1..12: note = Description of Artificial Sequence: Synthetic oligonucleotide
  source 1..12: mol_type = other DNA
tccctctgagag

SEQ ID NO: 1225 - DNA, 12 bp, synthetic construct
  misc_feature 1..12: note = Description of Artificial Sequence: Synthetic oligonucleotide
  source 1..12: mol_type = other DNA
gtggtggtttcc

SEQ ID NO: 1226 - DNA, 12 bp, synthetic construct
  misc_feature 1..12: note = Description of Artificial Sequence: Synthetic oligonucleotide
  source 1..12: mol_type = other DNA
gtttcacgcgaa

SEQ ID NO: 1227 - DNA, 12 bp, synthetic construct
  misc_feature 1..12: note = Description of Artificial Sequence: Synthetic oligonucleotide
  source 1..12: mol_type = other DNA
agtgatgtgact

SEQ ID NO: 1228 - DNA, 12 bp, synthetic construct
  misc_feature 1..12: note = Description of Artificial Sequence: Synthetic oligonucleotide
  source 1..12: mol_type = other DNA
aacgacacgctt

SEQ ID NO: 1229 - DNA, 12 bp, synthetic construct
  misc_feature 1..12: note = Description of Artificial Sequence: Synthetic oligonucleotide
  source 1..12: mol_type = other DNA
tccgataatcgg

SEQ ID NO: 1230 - DNA, 12 bp, synthetic construct
  misc_feature 1..12: note = Description of Artificial Sequence: Synthetic oligonucleotide
  source 1..12: mol_type = other DNA
aagttagtccgc

SEQ ID NO: 1231 - DNA, 12 bp, synthetic construct
  misc_feature 1..12: note = Description of Artificial Sequence: Synthetic oligonucleotide
  source 1..12: mol_type = other DNA
tagtatgcgcaa

SEQ ID NO: 1232 - DNA, 12 bp, synthetic construct
  misc_feature 1..12: note = Description of Artificial Sequence: Synthetic oligonucleotide
  source 1..12: mol_type = other DNA
acaagaaccttg

SEQ ID NO: 1233 - DNA, 12 bp, synthetic construct
  misc_feature 1..12: note = Description of Artificial Sequence: Synthetic oligonucleotide
  source 1..12: mol_type = other DNA
cttagctactct

SEQ ID NO: 1234 - DNA, 12 bp, synthetic construct
  misc_feature 1..12: note = Description of Artificial Sequence: Synthetic oligonucleotide
  source 1..12: mol_type = other DNA
cctggctgaata

SEQ ID NO: 1235 - DNA, 12 bp, synthetic construct
  misc_feature 1..12: note = Description of Artificial Sequence: Synthetic oligonucleotide
  source 1..12: mol_type = other DNA
ctttcaggaccg

SEQ ID NO: 1236 - DNA, 12 bp, synthetic construct
  misc_feature 1..12: note = Description of Artificial Sequence: Synthetic oligonucleotide
  source 1..12: mol_type = other DNA
tcagataccagc

SEQ ID NO: 1237 - DNA, 12 bp, synthetic construct
  misc_feature 1..12: note = Description of Artificial Sequence: Synthetic oligonucleotide
  source 1..12: mol_type = other DNA
tgcgctgaatgt

SEQ ID NO: 1238 - DNA, 12 bp, synthetic construct
  misc_feature 1..12: note = Description of Artificial Sequence: Synthetic oligonucleotide
  source 1..12: mol_type = other DNA
tactctcttagc

SEQ ID NO: 1239 - DNA, 12 bp, synthetic construct
  misc_feature 1..12: note = Description of Artificial Sequence: Synthetic oligonucleotide
  source 1..12: mol_type = other DNA
tcggtccatagc

SEQ ID NO: 1240 - DNA, 12 bp, synthetic construct
  misc_feature 1..12: note = Description of Artificial Sequence: Synthetic oligonucleotide
  source 1..12: mol_type = other DNA
ttcggatgtgaa

SEQ ID NO: 1241 - DNA, 12 bp, synthetic construct
  misc_feature 1..12: note = Description of Artificial Sequence: Synthetic oligonucleotide
  source 1..12: mol_type = other DNA
cgtcctacagtg

SEQ ID NO: 1242 - DNA, 12 bp, synthetic construct
  misc_feature 1..12: note = Description of Artificial Sequence: Synthetic oligonucleotide
  source 1..12: mol_type = other DNA
tcgaagacgtat

SEQ ID NO: 1243 - DNA, 12 bp, synthetic construct
  misc_feature 1..12: note = Description of Artificial Sequence: Synthetic oligonucleotide
  source 1..12: mol_type = other DNA
atggctgtcagt

SEQ ID NO: 1244 - DNA, 12 bp, synthetic construct
  misc_feature 1..12: note = Description of Artificial Sequence: Synthetic oligonucleotide
  source 1..12: mol_type = other DNA
aactgttcgcgc

SEQ ID NO: 1245 - DNA, 12 bp, synthetic construct
  misc_feature 1..12: note = Description of Artificial Sequence: Synthetic oligonucleotide
  source 1..12: mol_type = other DNA
cacgtttattcc

SEQ ID NO: 1246 - DNA, 12 bp, synthetic construct
  misc_feature 1..12: note = Description of Artificial Sequence: Synthetic oligonucleotide
  source 1..12: mol_type = other DNA
ctaggtccgact

SEQ ID NO: 1247 - DNA, 12 bp, synthetic construct
  misc_feature 1..12: note = Description of Artificial Sequence: Synthetic oligonucleotide
  source 1..12: mol_type = other DNA
gtaactcaacag

SEQ ID NO: 1248 - DNA, 12 bp, synthetic construct
  misc_feature 1..12: note = Description of Artificial Sequence: Synthetic oligonucleotide
  source 1..12: mol_type = other DNA
cacttctttgtg

SEQ ID NO: 1249 - DNA, 12 bp, synthetic construct
  misc_feature 1..12: note = Description of Artificial Sequence: Synthetic oligonucleotide
  source 1..12: mol_type = other DNA
gttctcttctcg

SEQ ID NO: 1250 - DNA, 12 bp, synthetic construct
  misc_feature 1..12: note = Description of Artificial Sequence: Synthetic oligonucleotide
  source 1..12: mol_type = other DNA
cgaagcatctac

SEQ ID NO: 1251 - DNA, 12 bp, synthetic construct
  misc_feature 1..12: note = Description of Artificial Sequence: Synthetic oligonucleotide
  source 1..12: mol_type = other DNA
gaaacggaaacg

SEQ ID NO: 1252 - DNA, 12 bp, synthetic construct
  misc_feature 1..12: note = Description of Artificial Sequence: Synthetic oligonucleotide
  source 1..12: mol_type = other DNA
agatcccgtacc

SEQ ID NO: 1253 - DNA, 12 bp, synthetic construct
  misc_feature 1..12: note = Description of Artificial Sequence: Synthetic oligonucleotide
  source 1..12: mol_type = other DNA
cgtggaagacga

SEQ ID NO: 1254 - DNA, 12 bp, synthetic construct
  misc_feature 1..12: note = Description of Artificial Sequence: Synthetic oligonucleotide
  source 1..12: mol_type = other DNA
cgtcgattgcac

SEQ ID NO: 1255 - DNA, 12 bp, synthetic construct
  misc_feature 1..12: note = Description of Artificial Sequence: Synthetic oligonucleotide
  source 1..12: mol_type = other DNA
cgtaagatgcct

SEQ ID NO: 1256 - DNA, 12 bp, synthetic construct
  misc_feature 1..12: note = Description of Artificial Sequence: Synthetic oligonucleotide
  source 1..12: mol_type = other DNA
gtttggccacac

SEQ ID NO: 1257 - DNA, 12 bp, synthetic construct
  misc_feature 1..12: note = Description of Artificial Sequence: Synthetic oligonucleotide
  source 1..12: mol_type = other DNA
ggtcgtgtcttg

SEQ ID NO: 1258 - DNA, 12 bp, synthetic construct
  misc_feature 1..12: note = Description of Artificial Sequence: Synthetic oligonucleotide
  source 1..12: mol_type = other DNA
tctggtgcatcg

SEQ ID NO: 1259 - DNA, 12 bp, synthetic construct
  misc_feature 1..12: note = Description of Artificial Sequence: Synthetic oligonucleotide
  source 1..12: mol_type = other DNA
gagagggatcac

SEQ ID NO: 1260 - DNA, 12 bp, synthetic construct
  misc_feature 1..12: note = Description of Artificial Sequence: Synthetic oligonucleotide
  source 1..12: mol_type = other DNA
gttgcctctgag

SEQ ID NO: 1261 - DNA, 12 bp, synthetic construct
  misc_feature 1..12: note = Description of Artificial Sequence: Synthetic oligonucleotide
  source 1..12: mol_type = other DNA
gcgttctagctg

SEQ ID NO: 1262 - DNA, 12 bp, synthetic construct
  misc_feature 1..12: note = Description of Artificial Sequence: Synthetic oligonucleotide
  source 1..12: mol_type = other DNA
tcaggttgccca

SEQ ID NO: 1263 - DNA, 12 bp, synthetic construct
  misc_feature 1..12: note = Description of Artificial Sequence: Synthetic oligonucleotide
  source 1..12: mol_type = other DNA
cgtcgtctaaga

SEQ ID NO: 1264 - DNA, 12 bp, synthetic construct
  misc_feature 1..12: note = Description of Artificial Sequence: Synthetic oligonucleotide
  source 1..12: mol_type = other DNA
cagctggttcaa

SEQ ID NO: 1265 - DNA, 12 bp, synthetic construct
  misc_feature 1..12: note = Description of Artificial Sequence: Synthetic oligonucleotide
  source 1..12: mol_type = other DNA
tcggcttggaat

SEQ ID NO: 1266 - DNA, 12 bp, synthetic construct
  misc_feature 1..12: note = Description of Artificial Sequence: Synthetic oligonucleotide
  source 1..12: mol_type = other DNA
cacctccaaggt

SEQ ID NO: 1267 - DNA, 12 bp, synthetic construct
  misc_feature 1..12: note = Description of Artificial Sequence: Synthetic oligonucleotide
  source 1..12: mol_type = other DNA
gttgttctggga

SEQ ID NO: 1268 - DNA, 12 bp, synthetic construct
  misc_feature 1..12: note = Description of Artificial Sequence: Synthetic oligonucleotide
  source 1..12: mol_type = other DNA
tcattccactca

SEQ ID NO: 1269 - DNA, 12 bp, synthetic construct
  misc_feature 1..12: note = Description of Artificial Sequence: Synthetic oligonucleotide
  source 1..12: mol_type = other DNA
caagcgttgtcc

SEQ ID NO: 1270 - DNA, 12 bp, synthetic construct
  misc_feature 1..12: note = Description of Artificial Sequence: Synthetic oligonucleotide
  source 1..12: mol_type = other DNA
gctggattgtca

SEQ ID NO: 1271 - DNA, 12 bp, synthetic construct
  misc_feature 1..12: note = Description of Artificial Sequence: Synthetic oligonucleotide
  source 1..12: mol_type = other DNA
tgaacaggttca

SEQ ID NO: 1272 - DNA, 12 bp, synthetic construct
  misc_feature 1..12: note = Description of Artificial Sequence: Synthetic oligonucleotide
  source 1..12: mol_type = other DNA
gtaagcctcgat

SEQ ID NO: 1273 - DNA, 12 bp, synthetic construct
  misc_feature 1..12: note = Description of Artificial Sequence: Synthetic oligonucleotide
  source 1..12: mol_type = other DNA
ggacttccagct

SEQ ID NO: 1274 - DNA, 12 bp, synthetic construct
  misc_feature 1..12: note = Description of Artificial Sequence: Synthetic oligonucleotide
  source 1..12: mol_type = other DNA
gtcacatcacga

SEQ ID NO: 1275 - DNA, 12 bp, synthetic construct
  misc_feature 1..12: note = Description of Artificial Sequence: Synthetic oligonucleotide
  source 1..12: mol_type = other DNA
gacttatgcccg

SEQ ID NO: 1276 - DNA, 12 bp, synthetic construct
  misc_feature 1..12: note = Description of Artificial Sequence: Synthetic oligonucleotide
  source 1..12: mol_type = other DNA
tcttgtttctgg

SEQ ID NO: 1277 - DNA, 12 bp, synthetic construct
  misc_feature 1..12: note = Description of Artificial Sequence: Synthetic oligonucleotide
  source 1..12: mol_type = other DNA
gagagatcgacg

SEQ ID NO: 1278 - DNA, 12 bp, synthetic construct
  misc_feature 1..12: note = Description of Artificial Sequence: Synthetic oligonucleotide
  source 1..12: mol_type = other DNA
ctccgctatagg

SEQ ID NO: 1279 - DNA, 12 bp, synthetic construct
  misc_feature 1..12: note = Description of Artificial Sequence: Synthetic oligonucleotide
  source 1..12: mol_type = other DNA
ctcacaaccgtg

SEQ ID NO: 1280 - DNA, 12 bp, synthetic construct
  misc_feature 1..12: note = Description of Artificial Sequence: Synthetic oligonucleotide
  source 1..12: mol_type = other DNA
cgacatttctct

SEQ ID NO: 1281 - DNA, 12 bp, synthetic construct
  misc_feature 1..12: note = Description of Artificial Sequence: Synthetic oligonucleotide
  source 1..12: mol_type = other DNA
gtgacgttagtc

SEQ ID NO: 1282 - DNA, 12 bp, synthetic construct
  misc_feature 1..12: note = Description of Artificial Sequence: Synthetic oligonucleotide
  source 1..12: mol_type = other DNA
ttgaacaagcca

SEQ ID NO: 1283 - DNA, 12 bp, synthetic construct
  misc_feature 1..12: note = Description of Artificial Sequence: Synthetic oligonucleotide
  source 1..12: mol_type = other DNA
atacaaacgcac

SEQ ID NO: 1284 - DNA, 12 bp, synthetic construct
  misc_feature 1..12: note = Description of Artificial Sequence: Synthetic oligonucleotide
  source 1..12: mol_type = other DNA
actgctatcgcg

SEQ ID NO: 1285 - DNA, 12 bp, synthetic construct
  misc_feature 1..12: note = Description of Artificial Sequence: Synthetic oligonucleotide
  source 1..12: mol_type = other DNA
ctgctattcctc

SEQ ID NO: 1286 - DNA, 12 bp, synthetic construct
  misc_feature 1..12: note = Description of Artificial Sequence: Synthetic oligonucleotide
  source 1..12: mol_type = other DNA
ggacgttaacta

SEQ ID NO: 1287 - DNA, 12 bp, synthetic construct
  misc_feature 1..12: note = Description of Artificial Sequence: Synthetic oligonucleotide
  source 1..12: mol_type = other DNA
gagtcttggtaa

SEQ ID NO: 1288 - DNA, 12 bp, synthetic construct
  misc_feature 1..12: note = Description of Artificial Sequence: Synthetic oligonucleotide
  source 1..12: mol_type = other DNA
ccaggttaatgc

SEQ ID NO: 1289 - DNA, 12 bp, synthetic construct
  misc_feature 1..12: note = Description of Artificial Sequence: Synthetic oligonucleotide
  source 1..12: mol_type = other DNA
gattcactgtgg

SEQ ID NO: 1290 - DNA, 12 bp, synthetic construct
  misc_feature 1..12: note = Description of Artificial Sequence: Synthetic oligonucleotide
  source 1..12: mol_type = other DNA
accacttgccag

SEQ ID NO: 1291 - DNA, 12 bp, synthetic construct
  misc_feature 1..12: note = Description of Artificial Sequence: Synthetic oligonucleotide
  source 1..12: mol_type = other DNA
atgtcaccgctg

SEQ ID NO: 1292 - DNA, 12 bp, synthetic construct
  misc_feature 1..12: note = Description of Artificial Sequence: Synthetic oligonucleotide
  source 1..12: mol_type = other DNA
tagcagttgcgt

SEQ ID NO: 1293 - DNA, 12 bp, synthetic construct
  misc_feature 1..12: note = Description of Artificial Sequence: Synthetic oligonucleotide
  source 1..12: mol_type = other DNA
tcgtcgccaaac

SEQ ID NO: 1294 - DNA, 12 bp, synthetic construct
  misc_feature 1..12: note = Description of Artificial Sequence: Synthetic oligonucleotide
  source 1..12: mol_type = other DNA
attcgtacctct

SEQ ID NO: 1295 - DNA, 12 bp, synthetic construct
  misc_feature 1..12: note = Description of Artificial Sequence: Synthetic oligonucleotide
  source 1..12: mol_type = other DNA
gcttgccaatcg

SEQ ID NO: 1296 - DNA, 12 bp, synthetic construct
  misc_feature 1..12: note = Description of Artificial Sequence: Synthetic oligonucleotide
  source 1..12: mol_type = other DNA
accagaaatgtc

SEQ ID NO: 1297 - DNA, 12 bp, synthetic construct
  misc_feature 1..12: note = Description of Artificial Sequence: Synthetic oligonucleotide
  source 1..12: mol_type = other DNA
tgtaacgccgat

SEQ ID NO: 1298 - DNA, 12 bp, synthetic construct
  misc_feature 1..12: note = Description of Artificial Sequence: Synthetic oligonucleotide
  source 1..12: mol_type = other DNA
cacgctattgga

SEQ ID NO: 1299 - DNA, 12 bp, synthetic construct
  misc_feature 1..12: note = Description of Artificial Sequence: Synthetic oligonucleotide
  source 1..12: mol_type = other DNA
aacatgcatgcc

SEQ ID NO: 1300 - DNA, 12 bp, synthetic construct
  misc_feature 1..12: note = Description of Artificial Sequence: Synthetic oligonucleotide
  source 1..12: mol_type = other DNA
tagcgttccaga

SEQ ID NO: 1301 - DNA, 12 bp, synthetic construct
  misc_feature 1..12: note = Description of Artificial Sequence: Synthetic oligonucleotide
  source 1..12: mol_type = other DNA
ctgacacgaata

SEQ ID NO: 1302 - DNA, 12 bp, synthetic construct
  misc_feature 1..12: note = Description of Artificial Sequence: Synthetic oligonucleotide
  source 1..12: mol_type = other DNA
atgcttgctctt

SEQ ID NO: 1303 - DNA, 12 bp, synthetic construct
  misc_feature 1..12: note = Description of Artificial Sequence: Synthetic oligonucleotide
  source 1..12: mol_type = other DNA
agcagaacatct

SEQ ID NO: 1304 - DNA, 12 bp, synthetic construct
  misc_feature 1..12: note = Description of Artificial Sequence: Synthetic oligonucleotide
  source 1..12: mol_type = other DNA
aacttcacttcc

SEQ ID NO: 1305 - DNA, 12 bp, synthetic construct
  misc_feature 1..12: note = Description of Artificial Sequence: Synthetic oligonucleotide
  source 1..12: mol_type = other DNA
gtctgttgagtg

SEQ ID NO: 1306 - DNA, 12 bp, synthetic construct
  misc_feature 1..12: note = Description of Artificial Sequence: Synthetic oligonucleotide
  source 1..12: mol_type = other DNA
ccagaagtgttc

SEQ ID NO: 1307 - DNA, 12 bp, synthetic construct
  misc_feature 1..12: note = Description of Artificial Sequence: Synthetic oligonucleotide
  source 1..12: mol_type = other DNA
gttctaaggtga

SEQ ID NO: 1308 - DNA, 12 bp, synthetic construct
  misc_feature 1..12: note = Description of Artificial Sequence: Synthetic oligonucleotide
  source 1..12: mol_type = other DNA
acagttgtacgc

SEQ ID NO: 1309 - DNA, 12 bp, synthetic construct
  misc_feature 1..12: note = Description of Artificial Sequence: Synthetic oligonucleotide
  source 1..12: mol_type = other DNA
tggagtaggtgg

SEQ ID NO: 1310 - DNA, 12 bp, synthetic construct
  misc_feature 1..12: note = Description of Artificial Sequence: Synthetic oligonucleotide
  source 1..12: mol_type = other DNA
ccagtggatata

SEQ ID NO: 1311 - DNA, 12 bp, synthetic construct
  misc_feature 1..12: note = Description of Artificial Sequence: Synthetic oligonucleotide
  source 1..12: mol_type = other DNA
tgagttcggtcc

SEQ ID NO: 1312 - DNA, 12 bp, synthetic construct
  misc_feature 1..12: note = Description of Artificial Sequence: Synthetic oligonucleotide
  source 1..12: mol_type = other DNA
acgatcatctgg

SEQ ID NO: 1313 - DNA, 12 bp, synthetic construct
  misc_feature 1..12: note = Description of Artificial Sequence: Synthetic oligonucleotide
  source 1..12: mol_type = other DNA
cgtgaatcaacc

SEQ ID NO: 1314 - DNA, 12 bp, synthetic construct
  misc_feature 1..12: note = Description of Artificial Sequence: Synthetic oligonucleotide
  source 1..12: mol_type = other DNA
agctactgcgtc

SEQ ID NO: 1315 - DNA, 12 bp, synthetic construct
  misc_feature 1..12: note = Description of Artificial Sequence: Synthetic oligonucleotide
  source 1..12: mol_type = other DNA
ttggctctattc

SEQ ID NO: 1316 - DNA, 12 bp, synthetic construct
  misc_feature 1..12: note = Description of Artificial Sequence: Synthetic oligonucleotide
  source 1..12: mol_type = other DNA
tgtgtgtaacgc

SEQ ID NO: 1317 - DNA, 12 bp, synthetic construct
  misc_feature 1..12: note = Description of Artificial Sequence: Synthetic oligonucleotide
  source 1..12: mol_type = other DNA
ttacgtggcgat

SEQ ID NO: 1318 - DNA, 12 bp, synthetic construct
  misc_feature 1..12: note = Description of Artificial Sequence: Synthetic oligonucleotide
  source 1..12: mol_type = other DNA
actgtacatgag

SEQ ID NO: 1319 - DNA, 12 bp, synthetic construct
  misc_feature 1..12: note = Description of Artificial Sequence: Synthetic oligonucleotide
  source 1..12: mol_type = other DNA
gagctaagttac

SEQ ID NO: 1320 - DNA, 12 bp, synthetic construct
  misc_feature 1..12: note = Description of Artificial Sequence: Synthetic oligonucleotide
  source 1..12: mol_type = other DNA
actgcccgatac

SEQ ID NO: 1321 - DNA, 12 bp, synthetic construct
  misc_feature 1..12: note = Description of Artificial Sequence: Synthetic oligonucleotide
  source 1..12: mol_type = other DNA
gatcccacgtac

SEQ ID NO: 1322 - DNA, 12 bp, synthetic construct
  misc_feature 1..12: note = Description of Artificial Sequence: Synthetic oligonucleotide
  source 1..12: mol_type = other DNA
ccaatcgtgcaa

SEQ ID NO: 1323 - DNA, 12 bp, synthetic construct
  misc_feature 1..12: note = Description of Artificial Sequence: Synthetic oligonucleotide
  source 1..12: mol_type = other DNA
caatgcctcacg

SEQ ID NO: 1324 - DNA, 12 bp, synthetic construct
  misc_feature 1..12: note = Description of Artificial Sequence: Synthetic oligonucleotide
  source 1..12: mol_type = other DNA
tgcccggactta

SEQ ID NO: 1325 - DNA, 12 bp, synthetic construct
  misc_feature 1..12: note = Description of Artificial Sequence: Synthetic oligonucleotide
  source 1..12: mol_type = other DNA
agcgattcctcg

SEQ ID NO: 1326 - DNA, 12 bp, synthetic construct
  misc_feature 1..12: note = Description of Artificial Sequence: Synthetic oligonucleotide
  source 1..12: mol_type = other DNA
cacagcgtccta

SEQ ID NO: 1327 - DNA, 12 bp, synthetic construct
  misc_feature 1..12: note = Description of Artificial Sequence: Synthetic oligonucleotide
  source 1..12: mol_type = other DNA
taccgcttcttc

SEQ ID NO: 1328 - DNA, 12 bp, synthetic construct
  misc_feature 1..12: note = Description of Artificial Sequence: Synthetic oligonucleotide
  source 1..12: mol_type = other DNA
aggctagcagag

SEQ ID NO: 1329 - DNA, 12 bp, synthetic construct
  misc_feature 1..12: note = Description of Artificial Sequence: Synthetic oligonucleotide
  source 1..12: mol_type = other DNA
tgtacggataac

SEQ ID NO: 1330 - DNA, 12 bp, synthetic construct
  misc_feature 1..12: note = Description of Artificial Sequence: Synthetic oligonucleotide
  source 1..12: mol_type = other DNA
atcccgtacgtg

SEQ ID NO: 1331 - DNA, 12 bp, synthetic construct
  misc_feature 1..12: note = Description of Artificial Sequence: Synthetic oligonucleotide
  source 1..12: mol_type = other DNA
ccaacccagatc

SEQ ID NO: 1332 - DNA, 12 bp, synthetic construct
  misc_feature 1..12: note = Description of Artificial Sequence: Synthetic oligonucleotide
  source 1..12: mol_type = other DNA
acgtccactgtg

SEQ ID NO: 1333 - DNA, 12 bp, synthetic construct
  misc_feature 1..12: note = Description of Artificial Sequence: Synthetic oligonucleotide
  source 1..12: mol_type = other DNA
tgtgcgataaca

SEQ ID NO: 1334 - DNA, 12 bp, synthetic construct
  misc_feature 1..12: note = Description of Artificial Sequence: Synthetic oligonucleotide
  source 1..12: mol_type = other DNA
gtcactccgaac

SEQ ID NO: 1335 - DNA, 12 bp, synthetic construct
  misc_feature 1..12: note = Description of Artificial Sequence: Synthetic oligonucleotide
  source 1..12: mol_type = other DNA
aatcaactaggc

SEQ ID NO: 1336 - DNA, 12 bp, synthetic construct
  misc_feature 1..12: note = Description of Artificial Sequence: Synthetic oligonucleotide
  source 1..12: mol_type = other DNA
cttgttgttctg

SEQ ID NO: 1337 - DNA, 12 bp, synthetic construct
  misc_feature 1..12: note = Description of Artificial Sequence: Synthetic oligonucleotide
  source 1..12: mol_type = other DNA
gattgctaccag

SEQ ID NO: 1338 - DNA, 12 bp, synthetic construct
  misc_feature 1..12: note = Description of Artificial Sequence: Synthetic oligonucleotide
  source 1..12: mol_type = other DNA
cgctaatcgtga

SEQ ID NO: 1339 - DNA, 12 bp, synthetic construct
  misc_feature 1..12: note = Description of Artificial Sequence: Synthetic oligonucleotide
  source 1..12: mol_type = other DNA
gattatcgacga

SEQ ID NO: 1340 - DNA, 12 bp, synthetic construct
  misc_feature 1..12: note = Description of Artificial Sequence: Synthetic oligonucleotide
  source 1..12: mol_type = other DNA
caccgaaatctg

SEQ ID NO: 1341 - DNA, 12 bp, synthetic construct
  misc_feature 1..12: note = Description of Artificial Sequence: Synthetic oligonucleotide
  source 1..12: mol_type = other DNA
gtgagggcaagt

SEQ ID NO: 1342 - DNA, 12 bp, synthetic construct
  misc_feature 1..12: note = Description of Artificial Sequence: Synthetic oligonucleotide
  source 1..12: mol_type = other DNA
tgacagaatcca

SEQ ID NO: 1343 - DNA, 12 bp, synthetic construct
  misc_feature 1..12: note = Description of Artificial Sequence: Synthetic oligonucleotide
  source 1..12: mol_type = other DNA
ggctctaacgta

SEQ ID NO: 1344 - DNA, 12 bp, synthetic construct
  misc_feature 1..12: note = Description of Artificial Sequence: Synthetic oligonucleotide
  source 1..12: mol_type = other DNA
ggccgttcgatt

SEQ ID NO: 1345 - DNA, 12 bp, synthetic construct
  misc_feature 1..12: note = Description of Artificial Sequence: Synthetic oligonucleotide
  source 1..12: mol_type = other DNA
gcctagcccaat

SEQ ID NO: 1346 - DNA, 12 bp, synthetic construct
  misc_feature 1..12: note = Description of Artificial Sequence: Synthetic oligonucleotide
  source 1..12: mol_type = other DNA
tgacgtagaact

SEQ ID NO: 1347 - DNA, 12 bp, synthetic construct
  misc_feature 1..12: note = Description of Artificial Sequence: Synthetic oligonucleotide
  source 1..12: mol_type = other DNA
cgtgggctcatt

SEQ ID NO: 1348 - DNA, 12 bp, synthetic construct
  misc_feature 1..12: note = Description of Artificial Sequence: Synthetic oligonucleotide
  source 1..12: mol_type = other DNA
cactgtatgaag

SEQ ID NO: 1349 - DNA, 12 bp, synthetic construct
  misc_feature 1..12: note = Description of Artificial Sequence: Synthetic oligonucleotide
  source 1..12: mol_type = other DNA
aatctgcaccga

SEQ ID NO: 1350 - DNA, 12 bp, synthetic construct
  misc_feature 1..12: note = Description of Artificial Sequence: Synthetic oligonucleotide
  source 1..12: mol_type = other DNA
ggaacttactcg

SEQ ID NO: 1351 - DNA, 12 bp, synthetic construct
  misc_feature 1..12: note = Description of Artificial Sequence: Synthetic oligonucleotide
  source 1..12: mol_type = other DNA
gatgtatgtggt

SEQ ID NO: 1352 - DNA, 12 bp, synthetic construct
  misc_feature 1..12: note = Description of Artificial Sequence: Synthetic oligonucleotide
  source 1..12: mol_type = other DNA
ctatgccggcta

SEQ ID NO: 1353 - DNA, 12 bp, synthetic construct
  misc_feature 1..12: note = Description of Artificial Sequence: Synthetic oligonucleotide
  source 1..12: mol_type = other DNA
cgtaccagatcc

SEQ ID NO: 1354 - DNA, 12 bp, synthetic construct
  misc_feature 1..12: note = Description of Artificial Sequence: Synthetic oligonucleotide
  source 1..12: mol_type = other DNA
tggatgcgcatt

SEQ ID NO: 1355 - DNA, 12 bp, synthetic construct
  misc_feature 1..12: note = Description of Artificial Sequence: Synthetic oligonucleotide
  source 1..12: mol_type = other DNA
ccagccttcaga

SEQ ID NO: 1356 - DNA, 12 bp, synthetic construct
  misc_feature 1..12: note = Description of Artificial Sequence: Synthetic oligonucleotide
  source 1..12: mol_type = other DNA
cagttacccaag

SEQ ID NO: 1357 - DNA, 12 bp, synthetic construct
  misc_feature 1..12: note = Description of Artificial Sequence: Synthetic oligonucleotide
  source 1..12: mol_type = other DNA
actccttgtgtt

SEQ ID NO: 1358 - DNA, 12 bp, synthetic construct
  misc_feature 1..12: note = Description of Artificial Sequence: Synthetic oligonucleotide
  source 1..12: mol_type = other DNA
gtggtatgggag

SEQ ID NO: 1359 - DNA, 12 bp, synthetic construct
  misc_feature 1..12: note = Description of Artificial Sequence: Synthetic oligonucleotide
  source 1..12: mol_type = other DNA
atgtttagacgg

SEQ ID NO: 1360 - DNA, 12 bp, synthetic construct
  misc_feature 1..12: note = Description of Artificial Sequence: Synthetic oligonucleotide
  source 1..12: mol_type = other DNA
gcccatatcaga

SEQ ID NO: 1361 - DNA, 12 bp, synthetic construct
  misc_feature 1..12: note = Description of Artificial Sequence: Synthetic oligonucleotide
  source 1..12: mol_type = other DNA
ccgtgttagaca

SEQ ID NO: 1362 - DNA, 12 bp, synthetic construct
  misc_feature 1..12: note = Description of Artificial Sequence: Synthetic oligonucleotide
  source 1..12: mol_type = other DNA
gagggacgcaat

SEQ ID NO: 1363 - DNA, 12 bp, synthetic construct
  misc_feature 1..12: note = Description of Artificial Sequence: Synthetic oligonucleotide
  source 1..12: mol_type = other DNA
gtcacggacatt

SEQ ID NO: 1364 - DNA, 12 bp, synthetic construct
  misc_feature 1..12: note = Description of Artificial Sequence: Synthetic oligonucleotide
  source 1..12: mol_type = other DNA
tgtaccaaccga

SEQ ID NO: 1365 - DNA, 12 bp, synthetic construct
  misc_feature 1..12: note = Description of Artificial Sequence: Synthetic oligonucleotide
  source 1..12: mol_type = other DNA
acatgtcacgtg

SEQ ID NO: 1366 - DNA, 12 bp, synthetic construct
  misc_feature 1..12: note = Description of Artificial Sequence: Synthetic oligonucleotide
  source 1..12: mol_type = other DNA
cgtgtgtgctca

SEQ ID NO: 1367 - DNA, 12 bp, synthetic construct
  misc_feature 1..12: note = Description of Artificial Sequence: Synthetic oligonucleotide
  source 1..12: mol_type = other DNA
acctctattcgt

SEQ ID NO: 1368 - DNA, 12 bp, synthetic construct
  misc_feature 1..12: note = Description of Artificial Sequence: Synthetic oligonucleotide
  source 1..12: mol_type = other DNA
taggccatgtaa

SEQ ID NO: 1369 - DNA, 12 bp, synthetic construct
  misc_feature 1..12: note = Description of Artificial Sequence: Synthetic oligonucleotide
  source 1..12: mol_type = other DNA
gcgagcgaagta

SEQ ID NO: 1370 - DNA, 12 bp, synthetic construct
  misc_feature 1..12: note = Description of Artificial Sequence: Synthetic oligonucleotide
  source 1..12: mol_type = other DNA
agggtacagggt

SEQ ID NO: 1371 - DNA, 12 bp, synthetic construct
  misc_feature 1..12: note = Description of Artificial Sequence: Synthetic oligonucleotide
  source 1..12: mol_type = other DNA
ctttagcgctgg

SEQ ID NO: 1372 - DNA, 12 bp, synthetic construct
  misc_feature 1..12: note = Description of Artificial Sequence: Synthetic oligonucleotide
  source 1..12: mol_type = other DNA
atccatgagcgt

SEQ ID NO: 1373 - DNA, 12 bp, synthetic construct
  misc_feature 1..12: note = Description of Artificial Sequence: Synthetic oligonucleotide
  source 1..12: mol_type = other DNA
ggcaaggcacaa

SEQ ID NO: 1374 - DNA, 12 bp, synthetic construct
  misc_feature 1..12: note = Description of Artificial Sequence: Synthetic oligonucleotide
  source 1..12: mol_type = other DNA
aaccgtcgccta

SEQ ID NO: 1375 - DNA, 12 bp, synthetic construct
  misc_feature 1..12: note = Description of Artificial Sequence: Synthetic oligonucleotide
  source 1..12: mol_type = other DNA
atctaccgaagc

SEQ ID NO: 1376 - DNA, 12 bp, synthetic construct
  misc_feature 1..12: note = Description of Artificial Sequence: Synthetic oligonucleotide
  source 1..12: mol_type = other DNA
agagtgctaatc

SEQ ID NO: 1377 - DNA, 12 bp, synthetic construct
  misc_feature 1..12: note = Description of Artificial Sequence: Synthetic oligonucleotide
  source 1..12: mol_type = other DNA
ctggtcttacgg

SEQ ID NO: 1378 - DNA, 12 bp, synthetic construct
  misc_feature 1..12: note = Description of Artificial Sequence: Synthetic oligonucleotide
  source 1..12: mol_type = other DNA
tagacttcagag

SEQ ID NO: 1379 - DNA, 12 bp, synthetic construct
  misc_feature 1..12: note = Description of Artificial Sequence: Synthetic oligonucleotide
  source 1..12: mol_type = other DNA
gccattatagag

SEQ ID NO: 1380 - DNA, 12 bp, synthetic construct
  misc_feature 1..12: note = Description of Artificial Sequence: Synthetic oligonucleotide
  source 1..12: mol_type = other DNA
ttacgaagttgg

SEQ ID NO: 1381 - DNA, 12 bp, synthetic construct
  misc_feature 1..12: note = Description of Artificial Sequence: Synthetic oligonucleotide
  source 1..12: mol_type = other DNA
acttggtgtaag

SEQ ID NO: 1382 - DNA, 12 bp, synthetic construct
  misc_feature 1..12: note = Description of Artificial Sequence: Synthetic oligonucleotide
  source 1..12: mol_type = other DNA
ttggcgggttat

SEQ ID NO: 1383 - DNA, 12 bp, synthetic construct
  misc_feature 1..12: note = Description of Artificial Sequence: Synthetic oligonucleotide
  source 1..12: mol_type = other DNA
caagtcgaatac

SEQ ID NO: 1384 - DNA, 12 bp, synthetic construct
  misc_feature 1..12: note = Description of Artificial Sequence: Synthetic oligonucleotide
  source 1..12: mol_type = other DNA
tgattcccggtg

SEQ ID NO: 1385 - DNA, 12 bp, synthetic construct
  misc_feature 1..12: note = Description of Artificial Sequence: Synthetic oligonucleotide
  source 1..12: mol_type = other DNA
taaccgaaccac

SEQ ID NO: 1386 - DNA, 12 bp, synthetic construct
  misc_feature 1..12: note = Description of Artificial Sequence: Synthetic oligonucleotide
  source 1..12: mol_type = other DNA
agatagctcgct

SEQ ID NO: 1387 - DNA, 12 bp, synthetic construct
  misc_feature 1..12: note = Description of Artificial Sequence: Synthetic oligonucleotide
  source 1..12: mol_type = other DNA
tcttggaggtca

SEQ ID NO: 1388 - DNA, 12 bp, synthetic construct
  misc_feature 1..12: note = Description of Artificial Sequence: Synthetic oligonucleotide
  source 1..12: mol_type = other DNA
cacgatggtcat

SEQ ID NO: 1389 - DNA, 12 bp, synthetic construct
  misc_feature 1..12: note = Description of Artificial Sequence: Synthetic oligonucleotide
  source 1..12: mol_type = other DNA
gcaagtgtgagg

SEQ ID NO: 1390 - DNA, 12 bp, synthetic construct
  misc_feature 1..12: note = Description of Artificial Sequence: Synthetic oligonucleotide
  source 1..12: mol_type = other DNA
agttccacggct

SEQ ID NO: 1391 - DNA, 12 bp, synthetic construct
  misc_feature 1..12: note = Description of Artificial Sequence: Synthetic oligonucleotide
  source 1..12: mol_type = other DNA
ggtgcgtcactt

SEQ ID NO: 1392 - DNA, 12 bp, synthetic construct
  misc_feature 1..12: note = Description of Artificial Sequence: Synthetic oligonucleotide
  source 1..12: mol_type = other DNA
ctggttggcatc

SEQ ID NO: 1393 - DNA, 12 bp, synthetic construct
  misc_feature 1..12: note = Description of Artificial Sequence: Synthetic oligonucleotide
  source 1..12: mol_type = other DNA
tcacctccttgt

SEQ ID NO: 1394 - DNA, 12 bp, synthetic construct
  misc_feature 1..12: note = Description of Artificial Sequence: Synthetic oligonucleotide
  source 1..12: mol_type = other DNA
gtcaccaatccg

SEQ ID NO: 1395 - DNA, 12 bp, synthetic construct
  misc_feature 1..12: note = Description of Artificial Sequence: Synthetic oligonucleotide
  source 1..12: mol_type = other DNA
ctcggtcaacca

SEQ ID NO: 1396 - DNA, 12 bp, synthetic construct
  misc_feature 1..12: note = Description of Artificial Sequence: Synthetic oligonucleotide
  source 1..12: mol_type = other DNA
ggaagcttaact

SEQ ID NO: 1397 - DNA, 12 bp, synthetic construct
  misc_feature 1..12: note = Description of Artificial Sequence: Synthetic oligonucleotide
  source 1..12: mol_type = other DNA
tgtgcttgtagg

SEQ ID NO: 1398 - DNA, 12 bp, synthetic construct
  misc_feature 1..12: note = Description of Artificial Sequence: Synthetic oligonucleotide
  source 1..12: mol_type = other DNA
ctgcttcttaca

SEQ ID NO: 1399 - DNA, 12 bp, synthetic construct
  misc_feature 1..12: note = Description of Artificial Sequence: Synthetic oligonucleotide
  source 1..12: mol_type = other DNA
gcacacctgata

SEQ ID NO: 1400 - DNA, 12 bp, synthetic construct
  misc_feature 1..12: note = Description of Artificial Sequence: Synthetic oligonucleotide
  source 1..12: mol_type = other DNA
cactaacaaacg

SEQ ID NO: 1401 - DNA, 12 bp, synthetic construct
  misc_feature 1..12: note = Description of Artificial Sequence: Synthetic oligonucleotide
  source 1..12: mol_type = other DNA
accctattgcgg

SEQ ID NO: 1402 - DNA, 12 bp, synthetic construct
  misc_feature 1..12: note = Description of Artificial Sequence: Synthetic oligonucleotide
  source 1..12: mol_type = other DNA
ggagacgttctt

SEQ ID NO: 1403 - DNA, 12 bp, synthetic construct
  misc_feature 1..12: note = Description of Artificial Sequence: Synthetic oligonucleotide
  source 1..12: mol_type = other DNA
tgactctgcggt

SEQ ID NO: 1404 - DNA, 12 bp, synthetic construct
  misc_feature 1..12: note = Description of Artificial Sequence: Synthetic oligonucleotide
  source 1..12: mol_type = other DNA
gttcgagtgaat

SEQ ID NO: 1405 - DNA, 12 bp, synthetic construct
  misc_feature 1..12: note = Description of Artificial Sequence: Synthetic oligonucleotide
  source 1..12: mol_type = other DNA
gcgacaattaca

SEQ ID NO: 1406 - DNA, 12 bp, synthetic construct
  misc_feature 1..12: note = Description of Artificial Sequence: Synthetic oligonucleotide
  source 1..12: mol_type = other DNA
ttccaggcagat

SEQ ID NO: 1407 - DNA, 12 bp, synthetic construct
  misc_feature 1..12: note = Description of Artificial Sequence: Synthetic oligonucleotide
  source 1..12: mol_type = other DNA
tccgttcgttta

SEQ ID NO: 1408 - DNA, 12 bp, synthetic construct
  misc_feature 1..12: note = Description of Artificial Sequence: Synthetic oligonucleotide
  source 1..12: mol_type = other DNA
attgcgctaccg

SEQ ID NO: 1409 - DNA, 12 bp, synthetic construct
  misc_feature 1..12: note = Description of Artificial Sequence: Synthetic oligonucleotide
  source 1..12: mol_type = other DNA
gtacactgatag

SEQ ID NO: 1410 - DNA, 12 bp, synthetic construct
  misc_feature 1..12: note = Description of Artificial Sequence: Synthetic oligonucleotide
  source 1..12: mol_type = other DNA
ttcttctaccgc

SEQ ID NO: 1411 - DNA, 12 bp, synthetic construct
  misc_feature 1..12: note = Description of Artificial Sequence: Synthetic oligonucleotide
  source 1..12: mol_type = other DNA
tcatgctccatt

SEQ ID NO: 1412 - DNA, 12 bp, synthetic construct
  misc_feature 1..12: note = Description of Artificial Sequence: Synthetic oligonucleotide
  source 1..12: mol_type = other DNA
tatggtacccag

SEQ ID NO: 1413 - DNA, 12 bp, synthetic construct
  misc_feature 1..12: note = Description of Artificial Sequence: Synthetic oligonucleotide
  source 1..12: mol_type = other DNA
accaccgtaacc

SEQ ID NO: 1414 - DNA, 12 bp, synthetic construct
  misc_feature 1..12: note = Description of Artificial Sequence: Synthetic oligonucleotide
  source 1..12: mol_type = other DNA
ccgaccagctta

SEQ ID NO: 1415 - DNA, 12 bp, synthetic construct
  misc_feature 1..12: note = Description of Artificial Sequence: Synthetic oligonucleotide
  source 1..12: mol_type = other DNA
ttacatcccttg

SEQ ID NO: 1416 - DNA, 12 bp, synthetic construct
  misc_feature 1..12: note = Description of Artificial Sequence: Synthetic oligonucleotide
  source 1..12: mol_type = other DNA
tctctcgatcat

SEQ ID NO: 1417 - DNA, 12 bp, synthetic construct
  misc_feature 1..12: note = Description of Artificial Sequence: Synthetic oligonucleotide
  source 1..12: mol_type = other DNA
agctgtcaagct

SEQ ID NO: 1418 - DNA, 12 bp, synthetic construct
  misc_feature 1..12: note = Description of Artificial Sequence: Synthetic oligonucleotide
  source 1..12: mol_type = other DNA
cacgacttgaca

SEQ ID NO: 1419 - DNA, 12 bp, synthetic construct
  misc_feature 1..12: note = Description of Artificial Sequence: Synthetic oligonucleotide
  source 1..12: mol_type = other DNA
catttcgcactt

SEQ ID NO: 1420 - DNA, 12 bp, synthetic construct
  misc_feature 1..12: note = Description of Artificial Sequence: Synthetic oligonucleotide
  source 1..12: mol_type = other DNA
caatccaccgaa

SEQ ID NO: 1421 - DNA, 12 bp, synthetic construct
  misc_feature 1..12: note = Description of Artificial Sequence: Synthetic oligonucleotide
  source 1..12: mol_type = other DNA
ggtgtgagaaag

SEQ ID NO: 1422 - DNA, 12 bp, synthetic construct
  misc_feature 1..12: note = Description of Artificial Sequence: Synthetic oligonucleotide
  source 1..12: mol_type = other DNA
aatccatgacag

SEQ ID NO: 1423 - DNA, 12 bp, synthetic construct
  misc_feature 1..12: note = Description of Artificial Sequence: Synthetic oligonucleotide
  source 1..12: mol_type = other DNA
gagagcaacaga

SEQ ID NO: 1424 - DNA, 12 bp, synthetic construct
  misc_feature 1..12: note = Description of Artificial Sequence: Synthetic oligonucleotide
  source 1..12: mol_type = other DNA
cttggaggctta

SEQ ID NO: 1425 - DNA, 12 bp, synthetic construct
  misc_feature 1..12: note = Description of Artificial Sequence: Synthetic oligonucleotide
  source 1..12: mol_type = other DNA
ttaagcgcctga

SEQ ID NO: 1426 - DNA, 12 bp, synthetic construct
  misc_feature 1..12: note = Description of Artificial Sequence: Synthetic oligonucleotide
  source 1..12: mol_type = other DNA
tacgcgtacagt

SEQ ID NO: 1427 - DNA, 12 bp, synthetic construct
  misc_feature 1..12: note = Description of Artificial Sequence: Synthetic oligonucleotide
  source 1..12: mol_type = other DNA
ctctttgtcgat

SEQ ID NO: 1428 - DNA, 12 bp, synthetic construct
  misc_feature 1..12: note = Description of Artificial Sequence: Synthetic oligonucleotide
  source 1..12: mol_type = other DNA
ggtattcaaagc

SEQ ID NO: 1429 - DNA, 12 bp, synthetic construct
  misc_feature 1..12: note = Description of Artificial Sequence: Synthetic oligonucleotide
  source 1..12: mol_type = other DNA
tactcgggaact

SEQ ID NO: 1430 - DNA, 12 bp, synthetic construct
  misc_feature 1..12: note = Description of Artificial Sequence: Synthetic oligonucleotide
  source 1..12: mol_type = other DNA
acgtggttccac

SEQ ID NO: 1431 - DNA, 12 bp, synthetic construct
  misc_feature 1..12: note = Description of Artificial Sequence: Synthetic oligonucleotide
  source 1..12: mol_type = other DNA
tgcgggattcat

SEQ ID NO: 1432 - DNA, 12 bp, synthetic construct
  misc_feature 1..12: note = Description of Artificial Sequence: Synthetic oligonucleotide
  source 1..12: mol_type = other DNA
ccgtcaagatgt

SEQ ID NO: 1433 - DNA, 12 bp, synthetic construct
  misc_feature 1..12: note = Description of Artificial Sequence: Synthetic oligonucleotide
  source 1..12: mol_type = other DNA
gtgaactggatt

SEQ ID NO: 1434 - DNA, 12 bp, synthetic construct
  misc_feature 1..12: note = Description of Artificial Sequence: Synthetic oligonucleotide
  source 1..12: mol_type = other DNA
ggtccacctaac

SEQ ID NO: 1435 - DNA, 12 bp, synthetic construct
  misc_feature 1..12: note = Description of Artificial Sequence: Synthetic oligonucleotide
  source 1..12: mol_type = other DNA
cgtgcttaggct

SEQ ID NO: 1436 - DNA, 12 bp, synthetic construct
  misc_feature 1..12: note = Description of Artificial Sequence: Synthetic oligonucleotide
  source 1..12: mol_type = other DNA
gacgctttgctg

SEQ ID NO: 1437 - DNA, 12 bp, synthetic construct
  misc_feature 1..12: note = Description of Artificial Sequence: Synthetic oligonucleotide
  source 1..12: mol_type = other DNA
caaactgcgttg

SEQ ID NO: 1438 - DNA, 12 bp, synthetic construct
  misc_feature 1..12: note = Description of Artificial Sequence: Synthetic oligonucleotide
  source 1..12: mol_type = other DNA
tacacgctgatg

SEQ ID NO: 1439 - DNA, 12 bp, synthetic construct
  misc_feature 1..12: note = Description of Artificial Sequence: Synthetic oligonucleotide
  source 1..12: mol_type = other DNA
cctaacggtcca

SEQ ID NO: 1440 - DNA, 12 bp, synthetic construct
  misc_feature 1..12: note = Description of Artificial Sequence: Synthetic oligonucleotide
  source 1..12: mol_type = other DNA
tgatcactcttc

SEQ ID NO: 1441 - DNA, 12 bp, synthetic construct
  misc_feature 1..12: note = Description of Artificial Sequence: Synthetic oligonucleotide
  source 1..12: mol_type = other DNA
taccgaaggtat

SEQ ID NO: 1442 - DNA, 12 bp, synthetic construct
  misc_feature 1..12: note = Description of Artificial Sequence: Synthetic oligonucleotide
  source 1..12: mol_type = other DNA
acagggtttgta

SEQ ID NO: 1443 - DNA, 12 bp, synthetic construct
  misc_feature 1..12: note = Description of Artificial Sequence: Synthetic oligonucleotide
  source 1..12: mol_type = other DNA
ttagactcggaa

SEQ ID NO: 1444 - DNA, 12 bp, synthetic construct
  misc_feature 1..12: note = Description of Artificial Sequence: Synthetic oligonucleotide
  source 1..12: mol_type = other DNA
cgtttcaaggac

SEQ ID NO: 1445 - DNA, 12 bp, synthetic construct
  misc_feature 1..12: note = Description of Artificial Sequence: Synthetic oligonucleotide
  source 1..12: mol_type = other DNA
tgtagccgcttg

SEQ ID NO: 1446 - DNA, 12 bp, synthetic construct
  misc_feature 1..12: note = Description of Artificial Sequence: Synthetic oligonucleotide
  source 1..12: mol_type = other DNA
ggcacgaaaggt

SEQ ID NO: 1447 - DNA, 12 bp, synthetic construct
  misc_feature 1..12: note = Description of Artificial Sequence: Synthetic oligonucleotide
  source 1..12: mol_type = other DNA
cactcatcattc

SEQ ID NO: 1448 - DNA, 12 bp, synthetic construct
  misc_feature 1..12: note = Description of Artificial Sequence: Synthetic oligonucleotide
  source 1..12: mol_type = other DNA
gcctatgagatc

SEQ ID NO: 1449 - DNA, 12 bp, synthetic construct
  misc_feature 1..12: note = Description of Artificial Sequence: Synthetic oligonucleotide
  source 1..12: mol_type = other DNA
gaccgataggga

SEQ ID NO: 1450 - DNA, 12 bp, synthetic construct
  misc_feature 1..12: note = Description of Artificial Sequence: Synthetic oligonucleotide
  source 1..12: mol_type = other DNA
gcagaacttagt

SEQ ID NO: 1451 - DNA, 12 bp, synthetic construct
  misc_feature 1..12: note = Description of Artificial Sequence: Synthetic oligonucleotide
  source 1..12: mol_type = other DNA
tacccgactaag

SEQ ID NO: 1452 - DNA, 12 bp, synthetic construct
  misc_feature 1..12: note = Description of Artificial Sequence: Synthetic oligonucleotide
  source 1..12: mol_type = other DNA
catgagactgta

SEQ ID NO: 1453 - DNA, 12 bp, synthetic construct
  misc_feature 1..12: note = Description of Artificial Sequence: Synthetic oligonucleotide
  source 1..12: mol_type = other DNA
gtatttcggacg

SEQ ID NO: 1454 - DNA, 12 bp, synthetic construct
  misc_feature 1..12: note = Description of Artificial Sequence: Synthetic oligonucleotide
  source 1..12: mol_type = other DNA
caaacctatggc

SEQ ID NO: 1455 - DNA, 12 bp, synthetic construct
  misc_feature 1..12: note = Description of Artificial Sequence: Synthetic oligonucleotide
  source 1..12: mol_type = other DNA
ggcgaactgaag

SEQ ID NO: 1456 - DNA, 12 bp, synthetic construct
  misc_feature 1..12: note = Description of Artificial Sequence: Synthetic oligonucleotide
  source 1..12: mol_type = other DNA
acccgttgatga

SEQ ID NO: 1457 - DNA, 12 bp, synthetic construct
  misc_feature 1..12: note = Description of Artificial Sequence: Synthetic oligonucleotide
  source 1..12: mol_type = other DNA
cgtagtaccaca

SEQ ID NO: 1458 - DNA, 12 bp, synthetic construct
  misc_feature 1..12: note = Description of Artificial Sequence: Synthetic oligonucleotide
  source 1..12: mol_type = other DNA
ggtcatcacgat

SEQ ID NO: 1459 - DNA, 12 bp, synthetic construct
  misc_feature 1..12: note = Description of Artificial Sequence: Synthetic oligonucleotide
  source 1..12: mol_type = other DNA
tatctatcctgc

SEQ ID NO: 1460 - DNA, 12 bp, synthetic construct
  misc_feature 1..12: note = Description of Artificial Sequence: Synthetic oligonucleotide
  source 1..12: mol_type = other DNA
atcgcttaaggc

SEQ ID NO: 1461 - DNA, 12 bp, synthetic construct
  misc_feature 1..12: note = Description of Artificial Sequence: Synthetic oligonucleotide
  source 1..12: mol_type = other DNA
cggcactatcac

SEQ ID NO: 1462 - DNA, 12 bp, synthetic construct
  misc_feature 1..12: note = Description of Artificial Sequence: Synthetic oligonucleotide
  source 1..12: mol_type = other DNA
gacgtagaacgg

SEQ ID NO: 1463 - DNA, 12 bp, synthetic construct
  misc_feature 1..12: note = Description of Artificial Sequence: Synthetic oligonucleotide
  source 1..12: mol_type = other DNA
cggagagacatg

SEQ ID NO: 1464 - DNA, 12 bp, synthetic construct
  misc_feature 1..12: note = Description of Artificial Sequence: Synthetic oligonucleotide
  source 1..12: mol_type = other DNA
agtctagagtac

SEQ ID NO: 1465 - DNA, 12 bp, synthetic construct
  misc_feature 1..12: note = Description of Artificial Sequence: Synthetic oligonucleotide
  source 1..12: mol_type = other DNA
ttgccaagagtc

SEQ ID NO: 1466 - DNA, 12 bp, synthetic construct
  misc_feature 1..12: note = Description of Artificial Sequence: Synthetic oligonucleotide
  source 1..12: mol_type = other DNA
accatccaacga

SEQ ID NO: 1467 - DNA, 12 bp, synthetic construct
  misc_feature 1..12: note = Description of Artificial Sequence: Synthetic oligonucleotide
  source 1..12: mol_type = other DNA
aggtggtggagt

SEQ ID NO: 1468 - DNA, 12 bp, synthetic construct
  misc_feature 1..12: note = Description of Artificial Sequence: Synthetic oligonucleotide
  source 1..12: mol_type = other DNA
cggtacctacca

SEQ ID NO: 1469 - DNA, 12 bp, synthetic construct
  misc_feature 1..12: note = Description of Artificial Sequence: Synthetic oligonucleotide
  source 1..12: mol_type = other DNA
ccaaagccagtt

SEQ ID NO: 1470 - DNA, 12 bp, synthetic construct
  misc_feature 1..12: note = Description of Artificial Sequence: Synthetic oligonucleotide
  source 1..12: mol_type = other DNA
tgcgcaaaggag

SEQ ID NO: 1471 - DNA, 12 bp, synthetic construct
  misc_feature 1..12: note = Description of Artificial Sequence: Synthetic oligonucleotide
  source 1..12: mol_type = other DNA
agtagcggaaga

SEQ ID NO: 1472 - DNA, 12 bp, synthetic construct
  misc_feature 1..12: note = Description of Artificial Sequence: Synthetic oligonucleotide
  source 1..12: mol_type = other DNA
gcaataggagga

SEQ ID NO: 1473 - DNA, 12 bp, synthetic construct
  misc_feature 1..12: note = Description of Artificial Sequence: Synthetic oligonucleotide
  source 1..12: mol_type = other DNA
attcccagaacg

SEQ ID NO: 1474 - DNA, 12 bp, synthetic construct
  misc_feature 1..12: note = Description of Artificial Sequence: Synthetic oligonucleotide
  source 1..12: mol_type = other DNA
gcgtttgctagc

SEQ ID NO: 1475 - DNA, 12 bp, synthetic construct
  misc_feature 1..12: note = Description of Artificial Sequence: Synthetic oligonucleotide
  source 1..12: mol_type = other DNA
tacgatgagttg

SEQ ID NO: 1476 - DNA, 12 bp, synthetic construct
  misc_feature 1..12: note = Description of Artificial Sequence: Synthetic oligonucleotide
  source 1..12: mol_type = other DNA
ggtttgcacatg

SEQ ID NO: 1477 - DNA, 12 bp, synthetic construct
  misc_feature 1..12: note = Description of Artificial Sequence: Synthetic oligonucleotide
  source 1..12: mol_type = other DNA
gcaattaggtac

SEQ ID NO: 1478 - DNA, 12 bp, synthetic construct
  misc_feature 1..12: note = Description of Artificial Sequence: Synthetic oligonucleotide
  source 1..12: mol_type = other DNA
ccgaacgtcact

SEQ ID NO: 1479 - DNA, 12 bp, synthetic construct
  misc_feature 1..12: note = Description of Artificial Sequence: Synthetic oligonucleotide
  source 1..12: mol_type = other DNA
agacgttgctac

SEQ ID NO: 1480 - DNA, 12 bp, synthetic construct
  misc_feature 1..12: note = Description of Artificial Sequence: Synthetic oligonucleotide
  source 1..12: mol_type = other DNA
agaaacagctct

SEQ ID NO: 1481 - DNA, 12 bp, synthetic construct
  misc_feature 1..12: note = Description of Artificial Sequence: Synthetic oligonucleotide
  source 1..12: mol_type = other DNA
gcttggtaggtt

SEQ ID NO: 1482 - DNA, 12 bp, synthetic construct
  misc_feature 1..12: note = Description of Artificial Sequence: Synthetic oligonucleotide
  source 1..12: mol_type = other DNA
tgggttaacaca

SEQ ID NO: 1483 - DNA, 12 bp, synthetic construct
  misc_feature 1..12: note = Description of Artificial Sequence: Synthetic oligonucleotide
  source 1..12: mol_type = other DNA
cataccgtgagt

SEQ ID NO: 1484 - DNA, 12 bp, synthetic construct
  misc_feature 1..12: note = Description of Artificial Sequence: Synthetic oligonucleotide
  source 1..12: mol_type = other DNA
acaccaacacca

SEQ ID NO: 1485 - DNA, 12 bp, synthetic construct
  misc_feature 1..12: note = Description of Artificial Sequence: Synthetic oligonucleotide
  source 1..12: mol_type = other DNA
agaatagcgctt

SEQ ID NO: 1486 - DNA, 12 bp, synthetic construct
  misc_feature 1..12: note = Description of Artificial Sequence: Synthetic oligonucleotide
  source 1..12: mol_type = other DNA
ctcagactcaga

SEQ ID NO: 1487 - DNA, 12 bp, synthetic construct
  misc_feature 1..12: note = Description of Artificial Sequence: Synthetic oligonucleotide
  source 1..12: mol_type = other DNA
ccggaatccata

SEQ ID NO: 1488 - DNA, 12 bp, synthetic construct
  misc_feature 1..12: note = Description of Artificial Sequence: Synthetic oligonucleotide
  source 1..12: mol_type = other DNA
taggttgcttgg

SEQ ID NO: 1489 - DNA, 12 bp, synthetic construct
  misc_feature 1..12: note = Description of Artificial Sequence: Synthetic oligonucleotide
  source 1..12: mol_type = other DNA
atgtgtgtagac

SEQ ID NO: 1490 - DNA, 12 bp, synthetic construct
  misc_feature 1..12: note = Description of Artificial Sequence: Synthetic oligonucleotide
  source 1..12: mol_type = other DNA
ccatcacatagg

SEQ ID NO: 1491 - DNA, 12 bp, synthetic construct
  misc_feature 1..12: note = Description of Artificial Sequence: Synthetic oligonucleotide
  source 1..12: mol_type = other DNA
aagcgtacattg

SEQ ID NO: 1492 - DNA, 12 bp, synthetic construct
  misc_feature 1..12: note = Description of Artificial Sequence: Synthetic oligonucleotide
  source 1..12: mol_type = other DNA
ccgagtacaatc

SEQ ID NO: 1493 - DNA, 12 bp, synthetic construct
  misc_feature 1..12: note = Description of Artificial Sequence: Synthetic oligonucleotide
  source 1..12: mol_type = other DNA
atcggcttccga

SEQ ID NO: 1494 - DNA, 12 bp, synthetic construct
  misc_feature 1..12: note = Description of Artificial Sequence: Synthetic oligonucleotide
  source 1..12: mol_type = other DNA
caggaaccagga

SEQ ID NO: 1495 - DNA, 12 bp, synthetic construct
  misc_feature 1..12: note = Description of Artificial Sequence: Synthetic oligonucleotide
  source 1..12: mol_type = other DNA
cctgcgaagtat

SEQ ID NO: 1496 - DNA, 12 bp, synthetic construct
  misc_feature 1..12: note = Description of Artificial Sequence: Synthetic oligonucleotide
  source 1..12: mol_type = other DNA
cgacacggagaa

SEQ ID NO: 1497 - DNA, 12 bp, synthetic construct
  misc_feature 1..12: note = Description of Artificial Sequence: Synthetic oligonucleotide
  source 1..12: mol_type = other DNA
gttatgacggat

SEQ ID NO: 1498 - DNA, 12 bp, synthetic construct
  misc_feature 1..12: note = Description of Artificial Sequence: Synthetic oligonucleotide
  source 1..12: mol_type = other DNA
gatatgaactgc

SEQ ID NO: 1499 - DNA, 12 bp, synthetic construct
  misc_feature 1..12: note = Description of Artificial Sequence: Synthetic oligonucleotide
  source 1..12: mol_type = other DNA
cactagacccac

SEQ ID NO: 1500 - DNA, 12 bp, synthetic construct
  misc_feature 1..12: note = Description of Artificial Sequence: Synthetic oligonucleotide
  source 1..12: mol_type = other DNA
tgctcgatgtgc

SEQ ID NO: 1501 - DNA, 12 bp, synthetic construct
  misc_feature 1..12: note = Description of Artificial Sequence: Synthetic oligonucleotide
  source 1..12: mol_type = other DNA
ttctctcgacat

SEQ ID NO: 1502 - DNA, 12 bp, synthetic construct
  misc_feature 1..12: note = Description of Artificial Sequence: Synthetic oligonucleotide
  source 1..12: mol_type = other DNA
gaacctatgaca

SEQ ID NO: 1503 - DNA, 12 bp, synthetic construct
  misc_feature 1..12: note = Description of Artificial Sequence: Synthetic oligonucleotide
  source 1..12: mol_type = other DNA
agcctcatgatg

SEQ ID NO: 1504 - DNA, 12 bp, synthetic construct
  misc_feature 1..12: note = Description of Artificial Sequence: Synthetic oligonucleotide
  source 1..12: mol_type = other DNA
gcagtctaagat

SEQ ID NO: 1505 - DNA, 12 bp, synthetic construct
  misc_feature 1..12: note = Description of Artificial Sequence: Synthetic oligonucleotide
  source 1..12: mol_type = other DNA
ggaaaggagaat

SEQ ID NO: 1506 - DNA, 12 bp, synthetic construct
  misc_feature 1..12: note = Description of Artificial Sequence: Synthetic oligonucleotide
  source 1..12: mol_type = other DNA
aggtttggcttg

SEQ ID NO: 1507 - DNA, 12 bp, synthetic construct
  misc_feature 1..12: note = Description of Artificial Sequence: Synthetic oligonucleotide
  source 1..12: mol_type = other DNA
gctctccgtaga

SEQ ID NO: 1508 - DNA, 12 bp, synthetic construct
  misc_feature 1..12: note = Description of Artificial Sequence: Synthetic oligonucleotide
  source 1..12: mol_type = other DNA
atgccggtaata

SEQ ID NO: 1509 - DNA, 12 bp, synthetic construct
  misc_feature 1..12: note = Description of Artificial Sequence: Synthetic oligonucleotide
  source 1..12: mol_type = other DNA
gtgtatcgccac

SEQ ID NO: 1510 - DNA, 12 bp, synthetic construct
  misc_feature 1..12: note = Description of Artificial Sequence: Synthetic oligonucleotide
  source 1..12: mol_type = other DNA
cggcgcattata

SEQ ID NO: 1511 - DNA, 12 bp, synthetic construct
  misc_feature 1..12: note = Description of Artificial Sequence: Synthetic oligonucleotide
  source 1..12: mol_type = other DNA
gagtatctgagt

SEQ ID NO: 1512 - DNA, 12 bp, synthetic construct
  misc_feature 1..12: note = Description of Artificial Sequence: Synthetic oligonucleotide
  source 1..12: mol_type = other DNA
tactccaggctg

SEQ ID NO: 1513 - DNA, 12 bp, synthetic construct
  misc_feature 1..12: note = Description of Artificial Sequence: Synthetic oligonucleotide
  source 1..12: mol_type = other DNA
gttaagctgacc

SEQ ID NO: 1514 - DNA, 12 bp, synthetic construct
  misc_feature 1..12: note = Description of Artificial Sequence: Synthetic oligonucleotide
  source 1..12: mol_type = other DNA
gaacagctctac

SEQ ID NO: 1515 - DNA, 12 bp, synthetic construct
  misc_feature 1..12: note = Description of Artificial Sequence: Synthetic oligonucleotide
  source 1..12: mol_type = other DNA
ccaaactcgtcg

SEQ ID NO: 1516 - DNA, 12 bp, synthetic construct
  misc_feature 1..12: note = Description of Artificial Sequence: Synthetic oligonucleotide
  source 1..12: mol_type = other DNA
ggtgctaatcac

SEQ ID NO: 1517 - DNA, 12 bp, synthetic construct
  misc_feature 1..12: note = Description of Artificial Sequence: Synthetic oligonucleotide
  source 1..12: mol_type = other DNA
ctcgctagatag

SEQ ID NO: 1518 - DNA, 12 bp, synthetic construct
  misc_feature 1..12: note = Description of Artificial Sequence: Synthetic oligonucleotide
  source 1..12: mol_type = other DNA
ttcggcatagtg

SEQ ID NO: 1519 - DNA, 12 bp, synthetic construct
  misc_feature 1..12: note = Description of Artificial Sequence: Synthetic oligonucleotide
  source 1..12: mol_type = other DNA
atgccatgccgt

SEQ ID NO: 1520 - DNA, 12 bp, synthetic construct
  misc_feature 1..12: note = Description of Artificial Sequence: Synthetic oligonucleotide
  source 1..12: mol_type = other DNA
gtgagtcatacc

SEQ ID NO: 1521 - DNA, 12 bp, synthetic construct
  misc_feature 1..12: note = Description of Artificial Sequence: Synthetic oligonucleotide
  source 1..12: mol_type = other DNA
acgtgaggaacg

SEQ ID NO: 1522 - DNA, 12 bp, synthetic construct
  misc_feature 1..12: note = Description of Artificial Sequence: Synthetic oligonucleotide
  source 1..12: mol_type = other DNA
cgtttggaatga

SEQ ID NO: 1523 - DNA, 12 bp, synthetic construct
  misc_feature 1..12: note = Description of Artificial Sequence: Synthetic oligonucleotide
  source 1..12: mol_type = other DNA
ccaggacaggaa

SEQ ID NO: 1524 - DNA, 12 bp, synthetic construct
  misc_feature 1..12: note = Description of Artificial Sequence: Synthetic oligonucleotide
  source 1..12: mol_type = other DNA
gtgccataatcg

SEQ ID NO: 1525 - DNA, 12 bp, synthetic construct
  misc_feature 1..12: note = Description of Artificial Sequence: Synthetic oligonucleotide
  source 1..12: mol_type = other DNA
gacattgtcacg

SEQ ID NO: 1526 - DNA, 12 bp, synthetic construct
  misc_feature 1..12: note = Description of Artificial Sequence: Synthetic oligonucleotide
  source 1..12: mol_type = other DNA
tggccgttactg

SEQ ID NO: 1527 - DNA, 12 bp, synthetic construct
  misc_feature 1..12: note = Description of Artificial Sequence: Synthetic oligonucleotide
  source 1..12: mol_type = other DNA
tgaatcgaagct

SEQ ID NO: 1528 - DNA, 12 bp, synthetic construct
  misc_feature 1..12: note = Description of Artificial Sequence: Synthetic oligonucleotide
  source 1..12: mol_type = other DNA
ggttagagcgga

SEQ ID NO: 1529 - DNA, 12 bp, synthetic construct
  misc_feature 1..12: note = Description of Artificial Sequence: Synthetic oligonucleotide
  source 1..12: mol_type = other DNA
aagggttagtct

SEQ ID NO: 1530 - DNA, 12 bp, synthetic construct
  misc_feature 1..12: note = Description of Artificial Sequence: Synthetic oligonucleotide
  source 1..12: mol_type = other DNA
tgcagatccaac

SEQ ID NO: 1531 - DNA, 12 bp, synthetic construct
  misc_feature 1..12: note = Description of Artificial Sequence: Synthetic oligonucleotide
  source 1..12: mol_type = other DNA
gccaacaaccat

SEQ ID NO: 1532 - DNA, 12 bp, synthetic construct
  misc_feature 1..12: note = Description of Artificial Sequence: Synthetic oligonucleotide
  source 1..12: mol_type = other DNA
tagagctgccat

SEQ ID NO: 1533 - DNA, 12 bp, synthetic construct
  misc_feature 1..12: note = Description of Artificial Sequence: Synthetic oligonucleotide
  source 1..12: mol_type = other DNA
ctgcagtaagta

SEQ ID NO: 1534 - DNA, 12 bp, synthetic construct
  misc_feature 1..12: note = Description of Artificial Sequence: Synthetic oligonucleotide
  source 1..12: mol_type = other DNA
gtagtagaccat

SEQ ID NO: 1535 - DNA, 12 bp, synthetic construct
  misc_feature 1..12: note = Description of Artificial Sequence: Synthetic oligonucleotide
  source 1..12: mol_type = other DNA
gtgactagtgat

SEQ ID NO: 1536 - DNA, 12 bp, synthetic construct
  misc_feature 1..12: note = Description of Artificial Sequence: Synthetic oligonucleotide
  source 1..12: mol_type = other DNA
tcactcttgtac

SEQ ID NO: 1537 - DNA, 12 bp, synthetic construct
  misc_feature 1..12: note = Description of Artificial Sequence: Synthetic oligonucleotide
  source 1..12: mol_type = other DNA
atcagtactagg

SEQ ID NO: 1538 - DNA, 12 bp, synthetic construct
  misc_feature 1..12: note = Description of Artificial Sequence: Synthetic oligonucleotide
  source 1..12: mol_type = other DNA
atctagtggcaa

SEQ ID NO: 1539 - DNA, 12 bp, synthetic construct
  misc_feature 1..12: note = Description of Artificial Sequence: Synthetic oligonucleotide
  source 1..12: mol_type = other DNA
tataggctccgc

SEQ ID NO: 1540 - DNA, 12 bp, synthetic construct
  misc_feature 1..12: note = Description of Artificial Sequence: Synthetic oligonucleotide
  source 1..12: mol_type = other DNA
atcaagatacgc

SEQ ID NO: 1541 - DNA, 12 bp, synthetic construct
  misc_feature 1..12: note = Description of Artificial Sequence: Synthetic oligonucleotide
  source 1..12: mol_type = other DNA
ggccttcagtca

SEQ ID NO: 1542 - DNA, 12 bp, synthetic construct
  misc_feature 1..12: note = Description of Artificial Sequence: Synthetic oligonucleotide
  source 1..12: mol_type = other DNA
tggtggagtttc

SEQ ID NO: 1543 - DNA, 12 bp, synthetic construct
  misc_feature 1..12: note = Description of Artificial Sequence: Synthetic oligonucleotide
  source 1..12: mol_type = other DNA
tcctcgagcgat

SEQ ID NO: 1544 - DNA, 12 bp, synthetic construct
  misc_feature 1..12: note = Description of Artificial Sequence: Synthetic oligonucleotide
  source 1..12: mol_type = other DNA
ccttcaatggga

SEQ ID NO: 1545 - DNA, 12 bp, synthetic construct
  misc_feature 1..12: note = Description of Artificial Sequence: Synthetic oligonucleotide
  source 1..12: mol_type = other DNA
atcgtgtgttgg

SEQ ID NO: 1546 - DNA, 12 bp, synthetic construct
  misc_feature 1..12: note = Description of Artificial Sequence: Synthetic oligonucleotide
  source 1..12: mol_type = other DNA
tctatctggctt

SEQ ID NO: 1547 - DNA, 12 bp, synthetic construct
  misc_feature 1..12: note = Description of Artificial Sequence: Synthetic oligonucleotide
  source 1..12: mol_type = other DNA
acacgtttgggt

SEQ ID NO: 1548 - DNA, 12 bp, synthetic construct
  misc_feature 1..12: note = Description of Artificial Sequence: Synthetic oligonucleotide
  source 1..12: mol_type = other DNA
agaacacggaag

SEQ ID NO: 1549 - DNA, 12 bp, synthetic construct
  misc_feature 1..12: note = Description of Artificial Sequence: Synthetic oligonucleotide
  source 1..12: mol_type = other DNA
acccaagcgtta

SEQ ID NO: 1550 - DNA, 12 bp, synthetic construct
  misc_feature 1..12: note = Description of Artificial Sequence: Synthetic oligonucleotide
  source 1..12: mol_type = other DNA
ttgacgacatcg

SEQ ID NO: 1551 - DNA, 12 bp, synthetic construct
  misc_feature 1..12: note = Description of Artificial Sequence: Synthetic oligonucleotide
  source 1..12: mol_type = other DNA
cttccgcagaca

SEQ ID NO: 1552 - DNA, 12 bp, synthetic construct
  misc_feature 1..12: note = Description of Artificial Sequence: Synthetic oligonucleotide
  source 1..12: mol_type = other DNA
ggaaacaaacgg

SEQ ID NO: 1553 - DNA, 12 bp, synthetic construct
  misc_feature 1..12: note = Description of Artificial Sequence: Synthetic oligonucleotide
  source 1..12: mol_type = other DNA
cgaacgtctatg

SEQ ID NO: 1554 - DNA, 12 bp, synthetic construct
  misc_feature 1..12: note = Description of Artificial Sequence: Synthetic oligonucleotide
  source 1..12: mol_type = other DNA
tcgaaacatgca

SEQ ID NO: 1555 - DNA, 12 bp, synthetic construct
  misc_feature 1..12: note = Description of Artificial Sequence: Synthetic oligonucleotide
  source 1..12: mol_type = other DNA
tgcagcaagatt

SEQ ID NO: 1556 - DNA, 12 bp, synthetic construct
  misc_feature 1..12: note = Description of Artificial Sequence: Synthetic oligonucleotide
  source 1..12: mol_type = other DNA
acatactgagca

SEQ ID NO: 1557 - DNA, 12 bp, synthetic construct
  misc_feature 1..12: note = Description of Artificial Sequence: Synthetic oligonucleotide
  source 1..12: mol_type = other DNA
gcactatacgca

SEQ ID NO: 1558 - DNA, 12 bp, synthetic construct
  misc_feature 1..12: note = Description of Artificial Sequence: Synthetic oligonucleotide
  source 1..12: mol_type = other DNA
gattggcatagt

SEQ ID NO: 1559 - DNA, 12 bp, synthetic construct
  misc_feature 1..12: note = Description of Artificial Sequence: Synthetic oligonucleotide
  source 1..12: mol_type = other DNA
tcatgtgaacga

SEQ ID NO: 1560 - DNA, 12 bp, synthetic construct
  misc_feature 1..12: note = Description of Artificial Sequence: Synthetic oligonucleotide
  source 1..12: mol_type = other DNA
aactaaggactc

SEQ ID NO: 1561 - DNA, 12 bp, synthetic construct
  misc_feature 1..12: note = Description of Artificial Sequence: Synthetic oligonucleotide
  source 1..12: mol_type = other DNA
agcaacattgca

SEQ ID NO: 1562 - DNA, 12 bp, synthetic construct
  misc_feature 1..12: note = Description of Artificial Sequence: Synthetic oligonucleotide
  source 1..12: mol_type = other DNA
ggctaaactatg

SEQ ID NO: 1563 - DNA, 12 bp, synthetic construct
  misc_feature 1..12: note = Description of Artificial Sequence: Synthetic oligonucleotide
  source 1..12: mol_type = other DNA
tctgggcattga

SEQ ID NO: 1564 - DNA, 12 bp, synthetic construct
  misc_feature 1..12: note = Description of Artificial Sequence: Synthetic oligonucleotide
  source 1..12: mol_type = other DNA
gagttgtacgat

SEQ ID NO: 1565 - DNA, 12 bp, synthetic construct
  misc_feature 1..12: note = Description of Artificial Sequence: Synthetic oligonucleotide
  source 1..12: mol_type = other DNA
tctccgttccct

SEQ ID NO: 1566 - DNA, 12 bp, synthetic construct
  misc_feature 1..12: note = Description of Artificial Sequence: Synthetic oligonucleotide
  source 1..12: mol_type = other DNA
aactcaatagcg

SEQ ID NO: 1567 - DNA, 12 bp, synthetic construct
  misc_feature 1..12: note = Description of Artificial Sequence: Synthetic oligonucleotide
  source 1..12: mol_type = other DNA
gatgtggtgtta

SEQ ID NO: 1568 - DNA, 12 bp, synthetic construct
  misc_feature 1..12: note = Description of Artificial Sequence: Synthetic oligonucleotide
  source 1..12: mol_type = other DNA
aagagcagagcc

SEQ ID NO: 1569 - DNA, 12 bp, synthetic construct
  misc_feature 1..12: note = Description of Artificial Sequence: Synthetic oligonucleotide
  source 1..12: mol_type = other DNA
ccaatgataagc

SEQ ID NO: 1570 - DNA, 12 bp, synthetic construct
  misc_feature 1..12: note = Description of Artificial Sequence: Synthetic oligonucleotide
  source 1..12: mol_type = other DNA
ctcgaaatgcaa

SEQ ID NO: 1571 - DNA, 12 bp, synthetic construct
  misc_feature 1..12: note = Description of Artificial Sequence: Synthetic oligonucleotide
  source 1..12: mol_type = other DNA
ctgattacgaga

SEQ ID NO: 1572 - DNA, 12 bp, synthetic construct
  misc_feature 1..12: note = Description of Artificial Sequence: Synthetic oligonucleotide
  source 1..12: mol_type = other DNA
cttagaacgtgc

SEQ ID NO: 1573 - DNA, 12 bp, synthetic construct
  misc_feature 1..12: note = Description of Artificial Sequence: Synthetic oligonucleotide
  source 1..12: mol_type = other DNA
cagaaatgtgtc

SEQ ID NO: 1574 - DNA, 12 bp, synthetic construct
  misc_feature 1..12: note = Description of Artificial Sequence: Synthetic oligonucleotide
  source 1..12: mol_type = other DNA
ggagagatcacg

SEQ ID NO: 1575 - DNA, 12 bp, synthetic construct
  misc_feature 1..12: note = Description of Artificial Sequence: Synthetic oligonucleotide
  source 1..12: mol_type = other DNA
ttaaaccgcgcc

SEQ ID NO: 1576 - DNA, 12 bp, synthetic construct
  misc_feature 1..12: note = Description of Artificial Sequence: Synthetic oligonucleotide
  source 1..12: mol_type = other DNA
agaagaaaggca

SEQ ID NO: 1577 - DNA, 12 bp, synthetic construct
  misc_feature 1..12: note = Description of Artificial Sequence: Synthetic oligonucleotide
  source 1..12: mol_type = other DNA
tctgaatggtag

SEQ ID NO: 1578 - DNA, 12 bp, synthetic construct
  misc_feature 1..12: note = Description of Artificial Sequence: Synthetic oligonucleotide
  source 1..12: mol_type = other DNA
ccgtatatgcgc

SEQ ID NO: 1579 - DNA, 12 bp, synthetic construct
  misc_feature 1..12: note = Description of Artificial Sequence: Synthetic oligonucleotide
  source 1..12: mol_type = other DNA
gtagaggtagag

SEQ ID NO: 1580 - DNA, 12 bp, synthetic construct
  misc_feature 1..12: note = Description of Artificial Sequence: Synthetic oligonucleotide
  source 1..12: mol_type = other DNA
tcaacccgtgaa

SEQ ID NO: 1581 - DNA, 12 bp, synthetic construct
  misc_feature 1..12: note = Description of Artificial Sequence: Synthetic oligonucleotide
  source 1..12: mol_type = other DNA
cttgcataccgg

SEQ ID NO: 1582 - DNA, 12 bp, synthetic construct
  misc_feature 1..12: note = Description of Artificial Sequence: Synthetic oligonucleotide
  source 1..12: mol_type = other DNA
ccactctctcta

SEQ ID NO: 1583 - DNA, 12 bp, synthetic construct
  misc_feature 1..12: note = Description of Artificial Sequence: Synthetic oligonucleotide
  source 1..12: mol_type = other DNA
catcgttggtcg

SEQ ID NO: 1584 - DNA, 12 bp, synthetic construct
  misc_feature 1..12: note = Description of Artificial Sequence: Synthetic oligonucleotide
  source 1..12: mol_type = other DNA
tatgacgtacga

SEQ ID NO: 1585 - DNA, 12 bp, synthetic construct
  misc_feature 1..12: note = Description of Artificial Sequence: Synthetic oligonucleotide
  source 1..12: mol_type = other DNA
cgtgatccgcta

SEQ ID NO: 1586 - DNA, 12 bp, synthetic construct
  misc_feature 1..12: note = Description of Artificial Sequence: Synthetic oligonucleotide
  source 1..12: mol_type = other DNA
gtttgaaacacg

SEQ ID NO: 1587 - DNA, 12 bp, synthetic construct
  misc_feature 1..12: note = Description of Artificial Sequence: Synthetic oligonucleotide
  source 1..12: mol_type = other DNA
gtgcacgataat

SEQ ID NO: 1588 - DNA, 12 bp, synthetic construct
  misc_feature 1..12: note = Description of Artificial Sequence: Synthetic oligonucleotide
  source 1..12: mol_type = other DNA
cctcctaattca

SEQ ID NO: 1589 - DNA, 12 bp, synthetic construct
  misc_feature 1..12: note = Description of Artificial Sequence: Synthetic oligonucleotide
  source 1..12: mol_type = other DNA
tagatcctcgga

SEQ ID NO: 1590 - DNA, 12 bp, synthetic construct
  misc_feature 1..12: note = Description of Artificial Sequence: Synthetic oligonucleotide
  source 1..12: mol_type = other DNA
tctctgaacagg

SEQ ID NO: 1591 - DNA, 12 bp, synthetic construct
  misc_feature 1..12: note = Description of Artificial Sequence: Synthetic oligonucleotide
  source 1..12: mol_type = other DNA
ggttatttggcg

SEQ ID NO: 1592 - DNA, 12 bp, synthetic construct
  misc_feature 1..12: note = Description of Artificial Sequence: Synthetic oligonucleotide
  source 1..12: mol_type = other DNA
agagagacaggt

SEQ ID NO: 1593 - DNA, 12 bp, synthetic construct
  misc_feature 1..12: note = Description of Artificial Sequence: Synthetic oligonucleotide
  source 1..12: mol_type = other DNA
ggtctaggtcta

SEQ ID NO: 1594 - DNA, 12 bp, synthetic construct
  misc_feature 1..12: note = Description of Artificial Sequence: Synthetic oligonucleotide
  source 1..12: mol_type = other DNA
ttcatggccagc

SEQ ID NO: 1595 - DNA, 12 bp, synthetic construct
  misc_feature 1..12: note = Description of Artificial Sequence: Synthetic oligonucleotide
  source 1..12: mol_type = other DNA
tcggacagtgtt

SEQ ID NO: 1596 - DNA, 12 bp, synthetic construct
  misc_feature 1..12: note = Description of Artificial Sequence: Synthetic oligonucleotide
  source 1..12: mol_type = other DNA
cctttatagtcc

SEQ ID NO: 1597 - DNA, 12 bp, synthetic construct
  misc_feature 1..12: note = Description of Artificial Sequence: Synthetic oligonucleotide
  source 1..12: mol_type = other DNA
ggatcgtaatac

SEQ ID NO: 1598 - DNA, 12 bp, synthetic construct
  misc_feature 1..12: note = Description of Artificial Sequence: Synthetic oligonucleotide
  source 1..12: mol_type = other DNA
tcgccagtgcat

SEQ ID NO: 1599 - DNA, 12 bp, synthetic construct
  misc_feature 1..12: note = Description of Artificial Sequence: Synthetic oligonucleotide
  source 1..12: mol_type = other DNA
tcaggacgtatc

SEQ ID NO: 1600 - DNA, 12 bp, synthetic construct
  misc_feature 1..12: note = Description of Artificial Sequence: Synthetic oligonucleotide
  source 1..12: mol_type = other DNA
attggacacgct

SEQ ID NO: 1601 - DNA, 12 bp, synthetic construct
  misc_feature 1..12: note = Description of Artificial Sequence: Synthetic oligonucleotide
  source 1..12: mol_type = other DNA
tgatgtgctaag

SEQ ID NO: 1602 - DNA, 12 bp, synthetic construct
  misc_feature 1..12: note = Description of Artificial Sequence: Synthetic oligonucleotide
  source 1..12: mol_type = other DNA
tgtaggtgtgct

SEQ ID NO: 1603 - DNA, 12 bp, synthetic construct
  misc_feature 1..12: note = Description of Artificial Sequence: Synthetic oligonucleotide
  source 1..12: mol_type = other DNA
gcatagcatcaa

SEQ ID NO: 1604 - DNA, 12 bp, synthetic construct
  misc_feature 1..12: note = Description of Artificial Sequence: Synthetic oligonucleotide
  source 1..12: mol_type = other DNA
gctcaggactct

SEQ ID NO: 1605 - DNA, 12 bp, synthetic construct
  misc_feature 1..12: note = Description of Artificial Sequence: Synthetic oligonucleotide
  source 1..12: mol_type = other DNA
gaaaggtgagaa

SEQ ID NO: 1606 - DNA, 12 bp, synthetic construct
  misc_feature 1..12: note = Description of Artificial Sequence: Synthetic oligonucleotide
  source 1..12: mol_type = other DNA
aattcacctcct

SEQ ID NO: 1607 - DNA, 12 bp, synthetic construct
  misc_feature 1..12: note = Description of Artificial Sequence: Synthetic oligonucleotide
  source 1..12: mol_type = other DNA
cagtaaatcgca

SEQ ID NO: 1608 - DNA, 12 bp, synthetic construct
  misc_feature 1..12: note = Description of Artificial Sequence: Synthetic oligonucleotide
  source 1..12: mol_type = other DNA
tcccacgaaaca

SEQ ID NO: 1609 - DNA, 12 bp, synthetic construct
  misc_feature 1..12: note = Description of Artificial Sequence: Synthetic oligonucleotide
  source 1..12: mol_type = other DNA
gtgttagatgtg

SEQ ID NO: 1610 - DNA, 12 bp, synthetic construct
  misc_feature 1..12: note = Description of Artificial Sequence: Synthetic oligonucleotide
  source 1..12: mol_type = other DNA
cactttgggtgc

SEQ ID NO: 1611 - DNA, 12 bp, synthetic construct
  misc_feature 1..12: note = Description of Artificial Sequence: Synthetic oligonucleotide
  source 1..12: mol_type = other DNA
gaatatacctgg

SEQ ID NO: 1612 - DNA, 12 bp, synthetic construct
  misc_feature 1..12: note = Description of Artificial Sequence: Synthetic oligonucleotide
  source 1..12: mol_type = other DNA
atgaagcactgt

SEQ ID NO: 1613 - DNA, 12 bp, synthetic construct
  misc_feature 1..12: note = Description of Artificial Sequence: Synthetic oligonucleotide
  source 1..12: mol_type = other DNA
caagtttccgcg

SEQ ID NO: 1614 - DNA, 12 bp, synthetic construct
  misc_feature 1..12: note = Description of Artificial Sequence: Synthetic oligonucleotide
  source 1..12: mol_type = other DNA
tacgctacgacc

SEQ ID NO: 1615 - DNA, 12 bp, synthetic construct
  misc_feature 1..12: note = Description of Artificial Sequence: Synthetic oligonucleotide
  source 1..12: mol_type = other DNA
ttagagccatgc

SEQ ID NO: 1616 - DNA, 12 bp, synthetic construct
  misc_feature 1..12: note = Description of Artificial Sequence: Synthetic oligonucleotide
  source 1..12: mol_type = other DNA
tctagcctggca

SEQ ID NO: 1617 - DNA, 12 bp, synthetic construct
  misc_feature 1..12: note = Description of Artificial Sequence: Synthetic oligonucleotide
  source 1..12: mol_type = other DNA
gtcgcttgcaca

SEQ ID NO: 1618 - DNA, 12 bp, synthetic construct
  misc_feature 1..12: note = Description of Artificial Sequence: Synthetic oligonucleotide
  source 1..12: mol_type = other DNA
ttgatgtgaggt

SEQ ID NO: 1619 - DNA, 12 bp, synthetic construct
  misc_feature 1..12: note = Description of Artificial Sequence: Synthetic oligonucleotide
  source 1..12: mol_type = other DNA
acatcgttgacg

SEQ ID NO: 1620 - DNA, 12 bp, synthetic construct
  misc_feature 1..12: note = Description of Artificial Sequence: Synthetic oligonucleotide
  source 1..12: mol_type = other DNA
gtcagtatggct

SEQ ID NO: 1621 - DNA, 12 bp, synthetic construct
  misc_feature 1..12: note = Description of Artificial Sequence: Synthetic oligonucleotide
  source 1..12: mol_type = other DNA
tgaaccctatgg

SEQ ID NO: 1622 - DNA, 12 bp, synthetic construct
  misc_feature 1..12: note = Description of Artificial Sequence: Synthetic oligonucleotide
  source 1..12: mol_type = other DNA
aatgcaatgcgt

SEQ ID NO: 1623 - DNA, 12 bp, synthetic construct
  misc_feature 1..12: note = Description of Artificial Sequence: Synthetic oligonucleotide
  source 1..12: mol_type = other DNA
tctaccacgaag

SEQ ID NO: 1624 - DNA, 12 bp, synthetic construct
  misc_feature 1..12: note = Description of Artificial Sequence: Synthetic oligonucleotide
  source 1..12: mol_type = other DNA
tcttgcggagtc

SEQ ID NO: 1625 - DNA, 12 bp, synthetic construct
  misc_feature 1..12: note = Description of Artificial Sequence: Synthetic oligonucleotide
  source 1..12: mol_type = other DNA
acgaaagagcag

SEQ ID NO: 1626 - DNA, 12 bp, synthetic construct
  misc_feature 1..12: note = Description of Artificial Sequence: Synthetic oligonucleotide
  source 1..12: mol_type = other DNA
ccatatcccgga

SEQ ID NO: 1627 - DNA, 12 bp, synthetic construct
  misc_feature 1..12: note = Description of Artificial Sequence: Synthetic oligonucleotide
  source 1..12: mol_type = other DNA
agagtcttgcca

SEQ ID NO: 1628 - DNA, 12 bp, synthetic construct
  misc_feature 1..12: note = Description of Artificial Sequence: Synthetic oligonucleotide
  source 1..12: mol_type = other DNA
cgaatgagtcat

SEQ ID NO: 1629 - DNA, 12 bp, synthetic construct
  misc_feature 1..12: note = Description of Artificial Sequence: Synthetic oligonucleotide
  source 1..12: mol_type = other DNA
aatatcgggatc

SEQ ID NO: 1630 - DNA, 12 bp, synthetic construct
  misc_feature 1..12: note = Description of Artificial Sequence: Synthetic oligonucleotide
  source 1..12: mol_type = other DNA
ttagtcgtgacg

SEQ ID NO: 1631 - DNA, 12 bp, synthetic construct
  misc_feature 1..12: note = Description of Artificial Sequence: Synthetic oligonucleotide
  source 1..12: mol_type = other DNA
tgatgaacccgt

SEQ ID NO: 1632 - DNA, 12 bp, synthetic construct
  misc_feature 1..12: note = Description of Artificial Sequence: Synthetic oligonucleotide
  source 1..12: mol_type = other DNA
tcgtaccaggat

SEQ ID NO: 1633 - DNA, 12 bp, synthetic construct
  misc_feature 1..12: note = Description of Artificial Sequence: Synthetic oligonucleotide
  source 1..12: mol_type = other DNA
acaacactccga

SEQ ID NO: 1634 - DNA, 12 bp, synthetic construct
  misc_feature 1..12: note = Description of Artificial Sequence: Synthetic oligonucleotide
  source 1..12: mol_type = other DNA
caacgctagaat

SEQ ID NO: 1635 - DNA, 12 bp, synthetic construct
  misc_feature 1..12: note = Description of Artificial Sequence: Synthetic oligonucleotide
  source 1..12: mol_type = other DNA
tagtgcattcgg

SEQ ID NO: 1636 - DNA, 12 bp, synthetic construct
  misc_feature 1..12: note = Description of Artificial Sequence: Synthetic oligonucleotide
  source 1..12: mol_type = other DNA
tgccagaccact

SEQ ID NO: 1637 - DNA, 12 bp, synthetic construct
  misc_feature 1..12: note = Description of Artificial Sequence: Synthetic oligonucleotide
  source 1..12: mol_type = other DNA
gctcttatgctt

SEQ ID NO: 1638 - DNA, 12 bp, synthetic construct
  misc_feature 1..12: note = Description of Artificial Sequence: Synthetic oligonucleotide
  source 1..12: mol_type = other DNA
agtgactgtcaa

SEQ ID NO: 1639 - DNA, 12 bp, synthetic construct
  misc_feature 1..12: note = Description of Artificial Sequence: Synthetic oligonucleotide
  source 1..12: mol_type = other DNA
cgatgctgttga

SEQ ID NO: 1640 - DNA, 12 bp, synthetic construct
  misc_feature 1..12: note = Description of Artificial Sequence: Synthetic oligonucleotide
  source 1..12: mol_type = other DNA
atcagagcccat

SEQ ID NO: 1641 - DNA, 12 bp, synthetic construct
  misc_feature 1..12: note = Description of Artificial Sequence: Synthetic oligonucleotide
  source 1..12: mol_type = other DNA
tcaatgaccgca

SEQ ID NO: 1642 - DNA, 12 bp, synthetic construct
  misc_feature 1..12: note = Description of Artificial Sequence: Synthetic oligonucleotide
  source 1..12: mol_type = other DNA
aggctccatgta

SEQ ID NO: 1643 - DNA, 12 bp, synthetic construct
  misc_feature 1..12: note = Description of Artificial Sequence: Synthetic oligonucleotide
  source 1..12: mol_type = other DNA
cgacctcgcata

SEQ ID NO: 1644 - DNA, 12 bp, synthetic construct
  misc_feature 1..12: note = Description of Artificial Sequence: Synthetic oligonucleotide
  source 1..12: mol_type = other DNA
ggtgagcaagca

SEQ ID NO: 1645 - DNA, 12 bp, synthetic construct
  misc_feature 1..12: note = Description of Artificial Sequence: Synthetic oligonucleotide
  source 1..12: mol_type = other DNA
acgactgcataa

SEQ ID NO: 1646 - DNA, 12 bp, synthetic construct
  misc_feature 1..12: note = Description of Artificial Sequence: Synthetic oligonucleotide
  source 1..12: mol_type = other DNA
tctgtagagcca

SEQ ID NO: 1647 - DNA, 12 bp, synthetic construct
  misc_feature 1..12: note = Description of Artificial Sequence: Synthetic oligonucleotide
  source 1..12: mol_type = other DNA
ctatcggaagat

SEQ ID NO: 1648 - DNA, 12 bp, synthetic construct
  misc_feature 1..12: note = Description of Artificial Sequence: Synthetic oligonucleotide
  source 1..12: mol_type = other DNA
actactgaggat

SEQ ID NO: 1649 - DNA, 12 bp, synthetic construct
  misc_feature 1..12: note = Description of Artificial Sequence: Synthetic oligonucleotide
  source 1..12: mol_type = other DNA
ctaattctctgc

SEQ ID NO: 1650 - DNA, 12 bp, synthetic construct
  misc_feature 1..12: note = Description of Artificial Sequence: Synthetic oligonucleotide
  source 1..12: mol_type = other DNA
agttcatacggc

SEQ ID NO: 1651 - DNA, 12 bp, synthetic construct
  misc_feature 1..12: note = Description of Artificial Sequence: Synthetic oligonucleotide
  source 1..12: mol_type = other DNA
acgcgaactaat

SEQ ID NO: 1652 - DNA, 12 bp, synthetic construct
  misc_feature 1..12: note = Description of Artificial Sequence: Synthetic oligonucleotide
  source 1..12: mol_type = other DNA
ccgactctaggt

SEQ ID NO: 1653 - DNA, 12 bp, synthetic construct
  misc_feature 1..12: note = Description of Artificial Sequence: Synthetic oligonucleotide
  source 1..12: mol_type = other DNA
cggattgctgta

SEQ ID NO: 1654 - DNA, 12 bp, synthetic construct
  misc_feature 1..12: note = Description of Artificial Sequence: Synthetic oligonucleotide
  source 1..12: mol_type = other DNA
tatctggaagtg

SEQ ID NO: 1655 - DNA, 12 bp, synthetic construct
  misc_feature 1..12: note = Description of Artificial Sequence: Synthetic oligonucleotide
  source 1..12: mol_type = other DNA
ggaagtggccaa

SEQ ID NO: 1656 - DNA, 12 bp, synthetic construct
  misc_feature 1..12: note = Description of Artificial Sequence: Synthetic oligonucleotide
  source 1..12: mol_type = other DNA
tcgctttaacct

SEQ ID NO: 1657 - DNA, 12 bp, synthetic construct
  misc_feature 1..12: note = Description of Artificial Sequence: Synthetic oligonucleotide
  source 1..12: mol_type = other DNA
agctatgtatgg

SEQ ID NO: 1658 - DNA, 12 bp, synthetic construct
  misc_feature 1..12: note = Description of Artificial Sequence: Synthetic oligonucleotide
  source 1..12: mol_type = other DNA
atcctacgagca

SEQ ID NO: 1659 - DNA, 12 bp, synthetic construct
  misc_feature 1..12: note = Description of Artificial Sequence: Synthetic oligonucleotide
  source 1..12: mol_type = other DNA
ggtactgtacca

SEQ ID NO: 1660 - DNA, 12 bp, synthetic construct
  misc_feature 1..12: note = Description of Artificial Sequence: Synthetic oligonucleotide
  source 1..12: mol_type = other DNA
cagctatggact

SEQ ID NO: 1661 - DNA, 12 bp, synthetic construct
  misc_feature 1..12: note = Description of Artificial Sequence: Synthetic oligonucleotide
  source 1..12: mol_type = other DNA
gataatgtgcac

SEQ ID NO: 1662 - DNA, 12 bp, synthetic construct
  misc_feature 1..12: note = Description of Artificial Sequence: Synthetic oligonucleotide
  source 1..12: mol_type = other DNA
ggcttacttgga

SEQ ID NO: 1663 - DNA, 12 bp, synthetic construct
  misc_feature 1..12: note = Description of Artificial Sequence: Synthetic oligonucleotide
  source 1..12: mol_type = other DNA
acgggtcatcat

SEQ ID NO: 1664 - DNA, 12 bp, synthetic construct
  misc_feature 1..12: note = Description of Artificial Sequence: Synthetic oligonucleotide
  source 1..12: mol_type = other DNA
gacaacgaatct

SEQ ID NO: 1665 - DNA, 12 bp, synthetic construct
  misc_feature 1..12: note = Description of Artificial Sequence: Synthetic oligonucleotide
  source 1..12: mol_type = other DNA
atcgaatcgagt

SEQ ID NO: 1666 - DNA, 12 bp, synthetic construct
  misc_feature 1..12: note = Description of Artificial Sequence: Synthetic oligonucleotide
  source 1..12: mol_type = other DNA
ttgctggacgct

SEQ ID NO: 1667 - DNA, 12 bp, synthetic construct
  misc_feature 1..12: note = Description of Artificial Sequence: Synthetic oligonucleotide
  source 1..12: mol_type = other DNA
ctctgaggtaac

SEQ ID NO: 1668 - DNA, 12 bp, synthetic construct
  misc_feature 1..12: note = Description of Artificial Sequence: Synthetic oligonucleotide
  source 1..12: mol_type = other DNA
ccatccgcaaca

SEQ ID NO: 1669 - DNA, 12 bp, synthetic construct
  misc_feature 1..12: note = Description of Artificial Sequence: Synthetic oligonucleotide
  source 1..12: mol_type = other DNA
gaaacatcccac

SEQ ID NO: 1670 - DNA, 12 bp, synthetic construct
  misc_feature 1..12: note = Description of Artificial Sequence: Synthetic oligonucleotide
  source 1..12: mol_type = other DNA
tgcggttgactc

SEQ ID NO: 1671 - DNA, 12 bp, synthetic construct
  misc_feature 1..12: note = Description of Artificial Sequence: Synthetic oligonucleotide
  source 1..12: mol_type = other DNA
ctagcagtatga

SEQ ID NO: 1672 - DNA, 12 bp, synthetic construct
  misc_feature 1..12: note = Description of Artificial Sequence: Synthetic oligonucleotide
  source 1..12: mol_type = other DNA
ctactagcggta

SEQ ID NO: 1673 - DNA, 12 bp, synthetic construct
  misc_feature 1..12: note = Description of Artificial Sequence: Synthetic oligonucleotide
  source 1..12: mol_type = other DNA
atttgctttgcc

SEQ ID NO: 1674 - DNA, 12 bp, synthetic construct
  misc_feature 1..12: note = Description of Artificial Sequence: Synthetic oligonucleotide
  source 1..12: mol_type = other DNA
cgcaatgaggga

SEQ ID NO: 1675 - DNA, 12 bp, synthetic construct
  misc_feature 1..12: note = Description of Artificial Sequence: Synthetic oligonucleotide
  source 1..12: mol_type = other DNA
cgtactctcgag

SEQ ID NO: 1676 - DNA, 12 bp, synthetic construct
  misc_feature 1..12: note = Description of Artificial Sequence: Synthetic oligonucleotide
  source 1..12: mol_type = other DNA
tgagaagaaagg

SEQ ID NO: 1677 - DNA, 12 bp, synthetic construct
  misc_feature 1..12: note = Description of Artificial Sequence: Synthetic oligonucleotide
  source 1..12: mol_type = other DNA
gttaatggcagt

SEQ ID NO: 1678 - DNA, 12 bp, synthetic construct
  misc_feature 1..12: note = Description of Artificial Sequence: Synthetic oligonucleotide
  source 1..12: mol_type = other DNA
tacaggacggga

SEQ ID NO: 1679 - DNA, 12 bp, synthetic construct
  misc_feature 1..12: note = Description of Artificial Sequence: Synthetic oligonucleotide
  source 1..12: mol_type = other DNA
tactggtaagac

SEQ ID NO: 1680 - DNA, 12 bp, synthetic construct
  misc_feature 1..12: note = Description of Artificial Sequence: Synthetic oligonucleotide
  source 1..12: mol_type = other DNA
gctacaagccct

SEQ ID NO: 1681 - DNA, 12 bp, synthetic construct
  misc_feature 1..12: note = Description of Artificial Sequence: Synthetic oligonucleotide
  source 1..12: mol_type = other DNA
tcagttctcgtt

SEQ ID NO: 1682 - DNA, 12 bp, synthetic construct
  misc_feature 1..12: note = Description of Artificial Sequence: Synthetic oligonucleotide
  source 1..12: mol_type = other DNA
tcggatctgtga

SEQ ID NO: 1683 - DNA, 12 bp, synthetic construct
  misc_feature 1..12: note = Description of Artificial Sequence: Synthetic oligonucleotide
  source 1..12: mol_type = other DNA
gtatggagctat

SEQ ID NO: 1684 - DNA, 12 bp, synthetic construct
  misc_feature 1..12: note = Description of Artificial Sequence: Synthetic oligonucleotide
  source 1..12: mol_type = other DNA
ctcaggagactt

SEQ ID NO: 1685 - DNA, 12 bp, synthetic construct
  misc_feature 1..12: note = Description of Artificial Sequence: Synthetic oligonucleotide
  source 1..12: mol_type = other DNA
ttgagaagcact

SEQ ID NO: 1686 - DNA, 12 bp, synthetic construct
  misc_feature 1..12: note = Description of Artificial Sequence: Synthetic oligonucleotide
  source 1..12: mol_type = other DNA
attgaagtctgg

SEQ ID NO: 1687 - DNA, 12 bp, synthetic construct
  misc_feature 1..12: note = Description of Artificial Sequence: Synthetic oligonucleotide
  source 1..12: mol_type = other DNA
tcgtgcgtgttg

SEQ ID NO: 1688 - DNA, 12 bp, synthetic construct
  misc_feature 1..12: note = Description of Artificial Sequence: Synthetic oligonucleotide
  source 1..12: mol_type = other DNA
gccggtactcta

SEQ ID NO: 1689 - DNA, 12 bp, synthetic construct
  misc_feature 1..12: note = Description of Artificial Sequence: Synthetic oligonucleotide
  source 1..12: mol_type = other DNA
ccttctgtatac

SEQ ID NO: 1690 - DNA, 12 bp, synthetic construct
  misc_feature 1..12: note = Description of Artificial Sequence: Synthetic oligonucleotide
  source 1..12: mol_type = other DNA
tcgttgggacta

SEQ ID NO: 1691 - DNA, 12 bp, synthetic construct
  misc_feature 1..12: note = Description of Artificial Sequence: Synthetic oligonucleotide
  source 1..12: mol_type = other DNA
ataacggtgtac

SEQ ID NO: 1692 - DNA, 12 bp, synthetic construct
  misc_feature 1..12: note = Description of Artificial Sequence: Synthetic oligonucleotide
  source 1..12: mol_type = other DNA
ggattacgctgt

SEQ ID NO: 1693 - DNA, 12 bp, synthetic construct
  misc_feature 1..12: note = Description of Artificial Sequence: Synthetic oligonucleotide
  source 1..12: mol_type = other DNA
gttatcgcatgg

SEQ ID NO: 1694 - DNA, 12 bp, synthetic construct
  misc_feature 1..12: note = Description of Artificial Sequence: Synthetic oligonucleotide
  source 1..12: mol_type = other DNA
cacaggattacc

SEQ ID NO: 1695 - DNA, 12 bp, synthetic construct
  misc_feature 1..12: note = Description of Artificial Sequence: Synthetic oligonucleotide
  source 1..12: mol_type = other DNA
acgctgtcggtt

SEQ ID NO: 1696 - DNA, 12 bp, synthetic construct
  misc_feature 1..12: note = Description of Artificial Sequence: Synthetic oligonucleotide
  source 1..12: mol_type = other DNA
gtccatggttcg

SEQ ID NO: 1697 - DNA, 12 bp, synthetic construct
  misc_feature 1..12: note = Description of Artificial Sequence: Synthetic oligonucleotide
  source 1..12: mol_type = other DNA
tcccgtagcatg

SEQ ID NO: 1698 - DNA, 12 bp, synthetic construct
  misc_feature 1..12: note = Description of Artificial Sequence: Synthetic oligonucleotide
  source 1..12: mol_type = other DNA
cagcagtcttcg

SEQ ID NO: 1699 - DNA, 12 bp, synthetic construct
  misc_feature 1..12: note = Description of Artificial Sequence: Synthetic oligonucleotide
  source 1..12: mol_type = other DNA
gatcacgagagg

SEQ ID NO: 1700 - DNA, 12 bp, synthetic construct
  misc_feature 1..12: note = Description of Artificial Sequence: Synthetic oligonucleotide
  source 1..12: mol_type = other DNA
cgatatcagtag

SEQ ID NO: 1701 - DNA, 12 bp, synthetic construct
  misc_feature 1..12: note = Description of Artificial Sequence: Synthetic oligonucleotide
  source 1..12: mol_type = other DNA
ctcgtttcagtt

SEQ ID NO: 1702 - DNA, 12 bp, synthetic construct
  misc_feature 1..12: note = Description of Artificial Sequence: Synthetic oligonucleotide
  source 1..12: mol_type = other DNA
tggcatgttggt

SEQ ID NO: 1703 - DNA, 12 bp, synthetic construct
  misc_feature 1..12: note = Description of Artificial Sequence: Synthetic oligonucleotide
  source 1..12: mol_type = other DNA
cagatgtcgcta

SEQ ID NO: 1704 - DNA, 12 bp, synthetic construct
  misc_feature 1..12: note = Description of Artificial Sequence: Synthetic oligonucleotide
  source 1..12: mol_type = other DNA
cgtagccaacat

SEQ ID NO: 1705 - DNA, 12 bp, synthetic construct
  misc_feature 1..12: note = Description of Artificial Sequence: Synthetic oligonucleotide
  source 1..12: mol_type = other DNA
gtaaattcaggc

SEQ ID NO: 1706 - DNA, 12 bp, synthetic construct
  misc_feature 1..12: note = Description of Artificial Sequence: Synthetic oligonucleotide
  source 1..12: mol_type = other DNA
cataagggaggc

SEQ ID NO: 1707 - DNA, 12 bp, synthetic construct
  misc_feature 1..12: note = Description of Artificial Sequence: Synthetic oligonucleotide
  source 1..12: mol_type = other DNA
gcgaacctatac

SEQ ID NO: 1708 - DNA, 12 bp, synthetic construct
  misc_feature 1..12: note = Description of Artificial Sequence: Synthetic oligonucleotide
  source 1..12: mol_type = other DNA
aatcgtaaggtc

SEQ ID NO: 1709 - DNA, 12 bp, synthetic construct
  misc_feature 1..12: note = Description of Artificial Sequence: Synthetic oligonucleotide
  source 1..12: mol_type = other DNA
tgagcaacatac

SEQ ID NO: 1710 - DNA, 12 bp, synthetic construct
  misc_feature 1..12: note = Description of Artificial Sequence: Synthetic oligonucleotide
  source 1..12: mol_type = other DNA
atacagcatacg

SEQ ID NO: 1711 - DNA, 12 bp, synthetic construct
  misc_feature 1..12: note = Description of Artificial Sequence: Synthetic oligonucleotide
  source 1..12: mol_type = other DNA
agtgtttcggac

SEQ ID NO: 1712 - DNA, 12 bp, synthetic construct
  misc_feature 1..12: note = Description of Artificial Sequence: Synthetic oligonucleotide
  source 1..12: mol_type = other DNA
tgtgttactcct

SEQ ID NO: 1713 - DNA, 12 bp, synthetic construct
  misc_feature 1..12: note = Description of Artificial Sequence: Synthetic oligonucleotide
  source 1..12: mol_type = other DNA
ctctcatatgct

SEQ ID NO: 1714 - DNA, 12 bp, synthetic construct
  misc_feature 1..12: note = Description of Artificial Sequence: Synthetic oligonucleotide
  source 1..12: mol_type = other DNA
cttacgagtaga

SEQ ID NO: 1715 - DNA, 12 bp, synthetic construct
  misc_feature 1..12: note = Description of Artificial Sequence: Synthetic oligonucleotide
  source 1..12: mol_type = other DNA
ggttcatgaaca

SEQ ID NO: 1716 - DNA, 12 bp, synthetic construct
  misc_feature 1..12: note = Description of Artificial Sequence: Synthetic oligonucleotide
  source 1..12: mol_type = other DNA
ctgagtgagtat

SEQ ID NO: 1717 - DNA, 12 bp, synthetic construct
  misc_feature 1..12: note = Description of Artificial Sequence: Synthetic oligonucleotide
  source 1..12: mol_type = other DNA
acacgcggttta

SEQ ID NO: 1718 - DNA, 12 bp, synthetic construct
  misc_feature 1..12: note = Description of Artificial Sequence: Synthetic oligonucleotide
  source 1..12: mol_type = other DNA
ggtacctgcaat

SEQ ID NO: 1719 - DNA, 12 bp, synthetic construct
  misc_feature 1..12: note = Description of Artificial Sequence: Synthetic oligonucleotide
  source 1..12: mol_type = other DNA
ccagtatcgcgt

SEQ ID NO: 1720 - DNA, 12 bp, synthetic construct
  misc_feature 1..12: note = Description of Artificial Sequence: Synthetic oligonucleotide
  source 1..12: mol_type = other DNA
caactgtcagac

SEQ ID NO: 1721 - DNA, 12 bp, synthetic construct
  misc_feature 1..12: note = Description of Artificial Sequence: Synthetic oligonucleotide
  source 1..12: mol_type = other DNA
gagcgagttagg

SEQ ID NO: 1722 - DNA, 12 bp, synthetic construct
  misc_feature 1..12: note = Description of Artificial Sequence: Synthetic oligonucleotide
  source 1..12: mol_type = other DNA
gcttgtaccgac

SEQ ID NO: 1723 - DNA, 12 bp, synthetic construct
  misc_feature 1..12: note = Description of Artificial Sequence: Synthetic oligonucleotide
  source 1..12: mol_type = other DNA
tggcaaatctag

SEQ ID NO: 1724 - DNA, 12 bp, synthetic construct
  misc_feature 1..12: note = Description of Artificial Sequence: Synthetic oligonucleotide
  source 1..12: mol_type = other DNA
tcgcctataagg

SEQ ID NO: 1725 - DNA, 12 bp, synthetic construct
  misc_feature 1..12: note = Description of Artificial Sequence: Synthetic oligonucleotide
  source 1..12: mol_type = other DNA
tcgtttcttcag

SEQ ID NO: 1726 - DNA, 12 bp, synthetic construct
  misc_feature 1..12: note = Description of Artificial Sequence: Synthetic oligonucleotide
  source 1..12: mol_type = other DNA
tgactgcgttag

SEQ ID NO: 1727 - DNA, 12 bp, synthetic construct
  misc_feature 1..12: note = Description of Artificial Sequence: Synthetic oligonucleotide
  source 1..12: mol_type = other DNA
gctcaatcagaa

SEQ ID NO: 1728 - DNA, 12 bp, synthetic construct
  misc_feature 1..12: note = Description of Artificial Sequence: Synthetic oligonucleotide
  source 1..12: mol_type = other DNA
cgctaggatgtt

SEQ ID NO: 1729 - DNA, 12 bp, synthetic construct
  misc_feature 1..12: note = Description of Artificial Sequence: Synthetic oligonucleotide
  source 1..12: mol_type = other DNA
caccttacctta

SEQ ID NO: 1730 - DNA, 12 bp, synthetic construct
  misc_feature 1..12: note = Description of Artificial Sequence: Synthetic oligonucleotide
  source 1..12: mol_type = other DNA
agtggcactatc

SEQ ID NO: 1731 - DNA, 12 bp, synthetic construct
  misc_feature 1..12: note = Description of Artificial Sequence: Synthetic oligonucleotide
  source 1..12: mol_type = other DNA
agtacctaagtg

SEQ ID NO: 1732 - DNA, 12 bp, synthetic construct
  misc_feature 1..12: note = Description of Artificial Sequence: Synthetic oligonucleotide
  source 1..12: mol_type = other DNA
ggctgatgtcat

SEQ ID NO: 1733 - DNA, 12 bp, synthetic construct
  misc_feature 1..12: note = Description of Artificial Sequence: Synthetic oligonucleotide
  source 1..12: mol_type = other DNA
gaccatgtagta

SEQ ID NO: 1734 - DNA, 12 bp, synthetic construct
  misc_feature 1..12: note = Description of Artificial Sequence: Synthetic oligonucleotide
  source 1..12: mol_type = other DNA
ggacaagtgcga

SEQ ID NO: 1735 - DNA, 12 bp, synthetic construct
  misc_feature 1..12: note = Description of Artificial Sequence: Synthetic oligonucleotide
  source 1..12: mol_type = other DNA
ttaaccttcctg

SEQ ID NO: 1736 - DNA, 12 bp, synthetic construct
  misc_feature 1..12: note = Description of Artificial Sequence: Synthetic oligonucleotide
  source 1..12: mol_type = other DNA
taacccgataga

SEQ ID NO: 1737 - DNA, 12 bp, synthetic construct
  misc_feature 1..12: note = Description of Artificial Sequence: Synthetic oligonucleotide
  source 1..12: mol_type = other DNA
ggatgcaggatg

SEQ ID NO: 1738 - DNA, 12 bp, synthetic construct
  misc_feature 1..12: note = Description of Artificial Sequence: Synthetic oligonucleotide
  source 1..12: mol_type = other DNA
tgtccagttcgg

SEQ ID NO: 1739 - DNA, 12 bp, synthetic construct
  misc_feature 1..12: note = Description of Artificial Sequence: Synthetic oligonucleotide
  source 1..12: mol_type = other DNA
cacacgcctgat

SEQ ID NO: 1740 - DNA, 12 bp, synthetic construct
  misc_feature 1..12: note = Description of Artificial Sequence: Synthetic oligonucleotide
  source 1..12: mol_type = other DNA
gttcgtatacgg

SEQ ID NO: 1741 - DNA, 12 bp, synthetic construct
  misc_feature 1..12: note = Description of Artificial Sequence: Synthetic oligonucleotide
  source 1..12: mol_type = other DNA
tgccgtatgcca

SEQ ID NO: 1742 - DNA, 12 bp, synthetic construct
  misc_feature 1..12: note = Description of Artificial Sequence: Synthetic oligonucleotide
  source 1..12: mol_type = other DNA
gtgtgctaacgt

SEQ ID NO: 1743 - DNA, 12 bp, synthetic construct
  misc_feature 1..12: note = Description of Artificial Sequence: Synthetic oligonucleotide
  source 1..12: mol_type = other DNA
ccacttgagagt

SEQ ID NO: 1744 - DNA, 12 bp, synthetic construct
  misc_feature 1..12: note = Description of Artificial Sequence: Synthetic oligonucleotide
  source 1..12: mol_type = other DNA
actcgtgatagc

SEQ ID NO: 1745 - DNA, 12 bp, synthetic construct
  misc_feature 1..12: note = Description of Artificial Sequence: Synthetic oligonucleotide
  source 1..12: mol_type = other DNA
tcttcgcagcag

SEQ ID NO: 1746 - DNA, 12 bp, synthetic construct
  misc_feature 1..12: note = Description of Artificial Sequence: Synthetic oligonucleotide
  source 1..12: mol_type = other DNA
cgggtagggtaa

SEQ ID NO: 1747 - DNA, 12 bp, synthetic construct
  misc_feature 1..12: note = Description of Artificial Sequence: Synthetic oligonucleotide
  source 1..12: mol_type = other DNA
cgtgacaatagt

SEQ ID NO: 1748 - DNA, 12 bp, synthetic construct
  misc_feature 1..12: note = Description of Artificial Sequence: Synthetic oligonucleotide
  source 1..12: mol_type = other DNA
cttgcggcaatc

SEQ ID NO: 1749 - DNA, 12 bp, synthetic construct
  misc_feature 1..12: note = Description of Artificial Sequence: Synthetic oligonucleotide
  source 1..12: mol_type = other DNA
gcacttcatttc

SEQ ID NO: 1750 - DNA, 12 bp, synthetic construct
  misc_feature 1..12: note = Description of Artificial Sequence: Synthetic oligonucleotide
  source 1..12: mol_type = other DNA
gccctcaaatgc

SEQ ID NO: 1751 - DNA, 12 bp, synthetic construct
  misc_feature 1..12: note = Description of Artificial Sequence: Synthetic oligonucleotide
  source 1..12: mol_type = other DNA
tctcatgtggag

SEQ ID NO: 1752 - DNA, 12 bp, synthetic construct
  misc_feature 1..12: note = Description of Artificial Sequence: Synthetic oligonucleotide
  source 1..12: mol_type = other DNA
atgcgcccgtat

SEQ ID NO: 1753 - DNA, 12 bp, synthetic construct
  misc_feature 1..12: note = Description of Artificial Sequence: Synthetic oligonucleotide
  source 1..12: mol_type = other DNA
cgctacaactcg

SEQ ID NO: 1754 - DNA, 12 bp, synthetic construct
  misc_feature 1..12: note = Description of Artificial Sequence: Synthetic oligonucleotide
  source 1..12: mol_type = other DNA
tgaggtttgatg

SEQ ID NO: 1755 - DNA, 12 bp, synthetic construct
  misc_feature 1..12: note = Description of Artificial Sequence: Synthetic oligonucleotide
  source 1..12: mol_type = other DNA
agaatccaccac

SEQ ID NO: 1756 - DNA, 12 bp, synthetic construct
  misc_feature 1..12: note = Description of Artificial Sequence: Synthetic oligonucleotide
  source 1..12: mol_type = other DNA
taaatcacgcgc

SEQ ID NO: 1757 - DNA, 12 bp, synthetic construct
  misc_feature 1..12: note = Description of Artificial Sequence: Synthetic oligonucleotide
  source 1..12: mol_type = other DNA
ttccatcatgtc

SEQ ID NO: 1758 - DNA, 12 bp, synthetic construct
  misc_feature 1..12: note = Description of Artificial Sequence: Synthetic oligonucleotide
  source 1..12: mol_type = other DNA
ctgtcgtgtcag

SEQ ID NO: 1759 - DNA, 12 bp, synthetic construct
  misc_feature 1..12: note = Description of Artificial Sequence: Synthetic oligonucleotide
  source 1..12: mol_type = other DNA
ttaagacagtcg

SEQ ID NO: 1760 - DNA, 12 bp, synthetic construct
  misc_feature 1..12: note = Description of Artificial Sequence: Synthetic oligonucleotide
  source 1..12: mol_type = other DNA
attgctggtcga

SEQ ID NO: 1761 - DNA, 12 bp, synthetic construct
  misc_feature 1..12: note = Description of Artificial Sequence: Synthetic oligonucleotide
  source 1..12: mol_type = other DNA
ctcaagtcaaag

SEQ ID NO: 1762 - DNA, 12 bp, synthetic construct
  misc_feature 1..12: note = Description of Artificial Sequence: Synthetic oligonucleotide
  source 1..12: mol_type = other DNA
ggcgtgcattat

SEQ ID NO: 1763 - DNA, 12 bp, synthetic construct
  misc_feature 1..12: note = Description of Artificial Sequence: Synthetic oligonucleotide
  source 1..12: mol_type = other DNA
gtcctacacagc

SEQ ID NO: 1764 - DNA, 12 bp, synthetic construct
  misc_feature 1..12: note = Description of Artificial Sequence: Synthetic oligonucleotide
  source 1..12: mol_type = other DNA
acggtgaaagcg

SEQ ID NO: 1765 - DNA, 12 bp, synthetic construct
  misc_feature 1..12: note = Description of Artificial Sequence: Synthetic oligonucleotide
  source 1..12: mol_type = other DNA
tctgcactgagc

SEQ ID NO: 1766 - DNA, 12 bp, synthetic construct
  misc_feature 1..12: note = Description of Artificial Sequence: Synthetic oligonucleotide
  source 1..12: mol_type = other DNA
aagaagccggac

SEQ ID NO: 1767 - DNA, 12 bp, synthetic construct
  misc_feature 1..12: note = Description of Artificial Sequence: Synthetic oligonucleotide
  source 1..12: mol_type = other DNA
gtacctagcctg

SEQ ID NO: 1768 - DNA, 12 bp, synthetic construct
  misc_feature 1..12: note = Description of Artificial Sequence: Synthetic oligonucleotide
  source 1..12: mol_type = other DNA
ggtcaatattgg

SEQ ID NO: 1769 - DNA, 12 bp, synthetic construct
  misc_feature 1..12: note = Description of Artificial Sequence: Synthetic oligonucleotide
  source 1..12: mol_type = other DNA
gaggtgggagtt

SEQ ID NO: 1770 - DNA, 12 bp, synthetic construct
  misc_feature 1..12: note = Description of Artificial Sequence: Synthetic oligonucleotide
  source 1..12: mol_type = other DNA
tcacgtattctc

SEQ ID NO: 1771 - DNA, 12 bp, synthetic construct
  misc_feature 1..12: note = Description of Artificial Sequence: Synthetic oligonucleotide
  source 1..12: mol_type = other DNA
cgcagattagta

SEQ ID NO: 1772 - DNA, 12 bp, synthetic construct
  misc_feature 1..12: note = Description of Artificial Sequence: Synthetic oligonucleotide
  source 1..12: mol_type = other DNA
acgggatacagg

SEQ ID NO: 1773 - DNA, 12 bp, synthetic construct
  misc_feature 1..12: note = Description of Artificial Sequence: Synthetic oligonucleotide
  source 1..12: mol_type = other DNA
cactgagtacgt

SEQ ID NO: 1774 - DNA, 12 bp, synthetic construct
  misc_feature 1..12: note = Description of Artificial Sequence: Synthetic oligonucleotide
  source 1..12: mol_type = other DNA
aggttcttaggc

SEQ ID NO: 1775 - DNA, 12 bp, synthetic construct
  misc_feature 1..12: note = Description of Artificial Sequence: Synthetic oligonucleotide
  source 1..12: mol_type = other DNA
tggcctagtcaa

SEQ ID NO: 1776 - DNA, 12 bp, synthetic construct
  misc_feature 1..12: note = Description of Artificial Sequence: Synthetic oligonucleotide
  source 1..12: mol_type = other DNA
gaaggtgaaggt

SEQ ID NO: 1777 - DNA, 12 bp, synthetic construct
  misc_feature 1..12: note = Description of Artificial Sequence: Synthetic oligonucleotide
  source 1..12: mol_type = other DNA
tgggtcccacat

SEQ ID NO: 1778 - DNA, 12 bp, synthetic construct
  misc_feature 1..12: note = Description of Artificial Sequence: Synthetic oligonucleotide
  source 1..12: mol_type = other DNA
aagagtctctag

SEQ ID NO: 1779 - DNA, 12 bp, synthetic construct
  misc_feature 1..12: note = Description of Artificial Sequence: Synthetic oligonucleotide
  source 1..12: mol_type = other DNA
tcaagcaatacg

SEQ ID NO: 1780 - DNA, 12 bp, synthetic construct
  misc_feature 1..12: note = Description of Artificial Sequence: Synthetic oligonucleotide
  source 1..12: mol_type = other DNA
taggtgcaatca

SEQ ID NO: 1781 - DNA, 12 bp, synthetic construct
  misc_feature 1..12: note = Description of Artificial Sequence: Synthetic oligonucleotide
  source 1..12: mol_type = other DNA
tccttccctgct

SEQ ID NO: 1782 - DNA, 12 bp, synthetic construct
  misc_feature 1..12: note = Description of Artificial Sequence: Synthetic oligonucleotide
  source 1..12: mol_type = other DNA
cacatgggtttg

SEQ ID NO: 1783 - DNA, 12 bp, synthetic construct
  misc_feature 1..12: note = Description of Artificial Sequence: Synthetic oligonucleotide
  source 1..12: mol_type = other DNA
cactggtgcata

SEQ ID NO: 1784 - DNA, 12 bp, synthetic construct
  misc_feature 1..12: note = Description of Artificial Sequence: Synthetic oligonucleotide
  source 1..12: mol_type = other DNA
tccgtcatgggt

SEQ ID NO: 1785 - DNA, 12 bp, synthetic construct
  misc_feature 1..12: note = Description of Artificial Sequence: Synthetic oligonucleotide
  source 1..12: mol_type = other DNA
catgttggaaca

SEQ ID NO: 1786 - DNA, 12 bp, synthetic construct
  misc_feature 1..12: note = Description of Artificial Sequence: Synthetic oligonucleotide
  source 1..12: mol_type = other DNA
gtccaaagcgtt

SEQ ID NO: 1787 - DNA, 12 bp, synthetic construct
  misc_feature 1..12: note = Description of Artificial Sequence: Synthetic oligonucleotide
  source 1..12: mol_type = other DNA
ctcactgcttct

SEQ ID NO: 1788 - DNA, 12 bp, synthetic construct
  misc_feature 1..12: note = Description of Artificial Sequence: Synthetic oligonucleotide
  source 1..12: mol_type = other DNA
taggtaaccgat

SEQ ID NO: 1789 - DNA, 12 bp, synthetic construct
  misc_feature 1..12: note = Description of Artificial Sequence: Synthetic oligonucleotide
  source 1..12: mol_type = other DNA
aacgtaggctct

SEQ ID NO: 1790 - DNA, 12 bp, synthetic construct
  misc_feature 1..12: note = Description of Artificial Sequence: Synthetic oligonucleotide
  source 1..12: mol_type = other DNA
agatctatgcag

SEQ ID NO: 1791 - DNA, 12 bp, synthetic construct
  misc_feature 1..12: note = Description of Artificial Sequence: Synthetic oligonucleotide
  source 1..12: mol_type = other DNA
atgggaccttca

SEQ ID NO: 1792 - DNA, 12 bp, synthetic construct
  misc_feature 1..12: note = Description of Artificial Sequence: Synthetic oligonucleotide
  source 1..12: mol_type = other DNA
agatcgtgccta

SEQ ID NO: 1793 - DNA, 12 bp, synthetic construct
  misc_feature 1..12: note = Description of Artificial Sequence: Synthetic oligonucleotide
  source 1..12: mol_type = other DNA
taggagagacag

SEQ ID NO: 1794 - DNA, 12 bp, synthetic construct
  misc_feature 1..12: note = Description of Artificial Sequence: Synthetic oligonucleotide
  source 1..12: mol_type = other DNA
ggtcgaattgct

SEQ ID NO: 1795 - DNA, 12 bp, synthetic construct
  misc_feature 1..12: note = Description of Artificial Sequence: Synthetic oligonucleotide
  source 1..12: mol_type = other DNA
agttgtagtccg

SEQ ID NO: 1796 - DNA, 12 bp, synthetic construct
  misc_feature 1..12: note = Description of Artificial Sequence: Synthetic oligonucleotide
  source 1..12: mol_type = other DNA
gcacaaggcaag

SEQ ID NO: 1797 - DNA, 12 bp, synthetic construct
  misc_feature 1..12: note = Description of Artificial Sequence: Synthetic oligonucleotide
  source 1..12: mol_type = other DNA
gctattcctcat

SEQ ID NO: 1798 - DNA, 12 bp, synthetic construct
  misc_feature 1..12: note = Description of Artificial Sequence: Synthetic oligonucleotide
  source 1..12: mol_type = other DNA
ctcctcccttac

SEQ ID NO: 1799 - DNA, 12 bp, synthetic construct
  misc_feature 1..12: note = Description of Artificial Sequence: Synthetic oligonucleotide
  source 1..12: mol_type = other DNA
tgttcctctcac

SEQ ID NO: 1800 - DNA, 12 bp, synthetic construct
  misc_feature 1..12: note = Description of Artificial Sequence: Synthetic oligonucleotide
  source 1..12: mol_type = other DNA
tgtaaacaggtc

SEQ ID NO: 1801 - DNA, 12 bp, synthetic construct
  misc_feature 1..12: note = Description of Artificial Sequence: Synthetic oligonucleotide
  source 1..12: mol_type = other DNA
tcgtcaaacccg

SEQ ID NO: 1802 - DNA, 12 bp, synthetic construct
  misc_feature 1..12: note = Description of Artificial Sequence: Synthetic oligonucleotide
  source 1..12: mol_type = other DNA
cggcaaacactt

SEQ ID NO: 1803 - DNA, 12 bp, synthetic construct
  misc_feature 1..12: note = Description of Artificial Sequence: Synthetic oligonucleotide
  source 1..12: mol_type = other DNA
gtctctgaaaga

SEQ ID NO: 1804 - DNA, 12 bp, synthetic construct
  misc_feature 1..12: note = Description of Artificial Sequence: Synthetic oligonucleotide
  source 1..12: mol_type = other DNA
gagcattacatg

SEQ ID NO: 1805 - DNA, 12 bp, synthetic construct
  misc_feature 1..12: note = Description of Artificial Sequence: Synthetic oligonucleotide
  source 1..12: mol_type = other DNA
gcgttaacccaa

SEQ ID NO: 1806 - DNA, 12 bp, synthetic construct
  misc_feature 1..12: note = Description of Artificial Sequence: Synthetic oligonucleotide
  source 1..12: mol_type = other DNA
gttacgtggttg

SEQ ID NO: 1807 - DNA, 12 bp, synthetic construct
  misc_feature 1..12: note = Description of Artificial Sequence: Synthetic oligonucleotide
  source 1..12: mol_type = other DNA
taatcggtgcca

SEQ ID NO: 1808 - DNA, 12 bp, synthetic construct
  misc_feature 1..12: note = Description of Artificial Sequence: Synthetic oligonucleotide
  source 1..12: mol_type = other DNA
gcgagttcctgt

SEQ ID NO: 1809 - DNA, 12 bp, synthetic construct
  misc_feature 1..12: note = Description of Artificial Sequence: Synthetic oligonucleotide
  source 1..12: mol_type = other DNA
gttctgcttgtt

SEQ ID NO: 1810 - DNA, 12 bp, synthetic construct
  misc_feature 1..12: note = Description of Artificial Sequence: Synthetic oligonucleotide
  source 1..12: mol_type = other DNA
aagcacgtctca

SEQ ID NO: 1811 - DNA, 12 bp, synthetic construct
  misc_feature 1..12: note = Description of Artificial Sequence: Synthetic oligonucleotide
  source 1..12: mol_type = other DNA
ccacacgtttgg

SEQ ID NO: 1812 - DNA, 12 bp, synthetic construct
  misc_feature 1..12: note = Description of Artificial Sequence: Synthetic oligonucleotide
  source 1..12: mol_type = other DNA
aggatcagggaa

SEQ ID NO: 1813 - DNA, 12 bp, synthetic construct
  misc_feature 1..12: note = Description of Artificial Sequence: Synthetic oligonucleotide
  source 1..12: mol_type = other DNA
ttgatccggtag

SEQ ID NO: 1814 - DNA, 12 bp, synthetic construct
  misc_feature 1..12: note = Description of Artificial Sequence: Synthetic oligonucleotide
  source 1..12: mol_type = other DNA
ttccgaatcggc

SEQ ID NO: 1815 - DNA, 12 bp, synthetic construct
  misc_feature 1..12: note = Description of Artificial Sequence: Synthetic oligonucleotide
  source 1..12: mol_type = other DNA
gtcaagacctca

SEQ ID NO: 1816 - DNA, 12 bp, synthetic construct
  misc_feature 1..12: note = Description of Artificial Sequence: Synthetic oligonucleotide
  source 1..12: mol_type = other DNA
tagggagaccga

SEQ ID NO: 1817 - DNA, 12 bp, synthetic construct
  misc_feature 1..12: note = Description of Artificial Sequence: Synthetic oligonucleotide
  source 1..12: mol_type = other DNA
acagcatagctc

SEQ ID NO: 1818 - DNA, 12 bp, synthetic construct
  misc_feature 1..12: note = Description of Artificial Sequence: Synthetic oligonucleotide
  source 1..12: mol_type = other DNA
taggacgggagt

SEQ ID NO: 1819 - DNA, 12 bp, synthetic construct
  misc_feature 1..12: note = Description of Artificial Sequence: Synthetic oligonucleotide
  source 1..12: mol_type = other DNA
cgggtgtttgct

SEQ ID NO: 1820 - DNA, 12 bp, synthetic construct
  misc_feature 1..12: note = Description of Artificial Sequence: Synthetic oligonucleotide
  source 1..12: mol_type = other DNA
tacctagtgaga

SEQ ID NO: 1821 - DNA, 12 bp, synthetic construct
  misc_feature 1..12: note = Description of Artificial Sequence: Synthetic oligonucleotide
  source 1..12: mol_type = other DNA
ttgttacgttcc

SEQ ID NO: 1822 - DNA, 12 bp, synthetic construct
  misc_feature 1..12: note = Description of Artificial Sequence: Synthetic oligonucleotide
  source 1..12: mol_type = other DNA
ataagcccaatg

SEQ ID NO: 1823 - DNA, 12 bp, synthetic construct
  misc_feature 1..12: note = Description of Artificial Sequence: Synthetic oligonucleotide
  source 1..12: mol_type = other DNA
aatgtggctcac

SEQ ID NO: 1824 - DNA, 12 bp, synthetic construct
  misc_feature 1..12: note = Description of Artificial Sequence: Synthetic oligonucleotide
  source 1..12: mol_type = other DNA
gcaacgaacgag

SEQ ID NO: 1825 - DNA, 12 bp, synthetic construct
  misc_feature 1..12: note = Description of Artificial Sequence: Synthetic oligonucleotide
  source 1..12: mol_type = other DNA
ttgaccgcggtt

SEQ ID NO: 1826 - DNA, 12 bp, synthetic construct
  misc_feature 1..12: note = Description of Artificial Sequence: Synthetic oligonucleotide
  source 1..12: mol_type = other DNA
cgttctggtggt

SEQ ID NO: 1827 - DNA, 12 bp, synthetic construct
  misc_feature 1..12: note = Description of Artificial Sequence: Synthetic oligonucleotide
  source 1..12: mol_type = other DNA
cagttcgagata

SEQ ID NO: 1828 - DNA, 12 bp, synthetic construct
  misc_feature 1..12: note = Description of Artificial Sequence: Synthetic oligonucleotide
  source 1..12: mol_type = other DNA
acgtgccttaga

SEQ ID NO: 1829 - DNA, 12 bp, synthetic construct
  misc_feature 1..12: note = Description of Artificial Sequence: Synthetic oligonucleotide
  source 1..12: mol_type = other DNA
gagttccattgg

SEQ ID NO: 1830 - DNA, 12 bp, synthetic construct
  misc_feature 1..12: note = Description of Artificial Sequence: Synthetic oligonucleotide
  source 1..12: mol_type = other DNA
tgacggtttagc

SEQ ID NO: 1831 - DNA, 12 bp, synthetic construct
  misc_feature 1..12: note = Description of Artificial Sequence: Synthetic oligonucleotide
  source 1..12: mol_type = other DNA
gtgcaaccaatc

SEQ ID NO: 1832 - DNA, 12 bp, synthetic construct
  misc_feature 1..12: note = Description of Artificial Sequence: Synthetic oligonucleotide
  source 1..12: mol_type = other DNA
ttggtctcctct

SEQ ID NO: 1833 - DNA, 12 bp, synthetic construct
  misc_feature 1..12: note = Description of Artificial Sequence: Synthetic oligonucleotide
  source 1..12: mol_type = other DNA
aatgtcaccaga

SEQ ID NO: 1834 - DNA, 12 bp, synthetic construct
  misc_feature 1..12: note = Description of Artificial Sequence: Synthetic oligonucleotide
  source 1..12: mol_type = other DNA
tcctgctatcta

SEQ ID NO: 1835 - DNA, 12 bp, synthetic construct
  misc_feature 1..12: note = Description of Artificial Sequence: Synthetic oligonucleotide
  source 1..12: mol_type = other DNA
tctgatcgaggt

SEQ ID NO: 1836 - DNA, 12 bp, synthetic construct
  misc_feature 1..12: note = Description of Artificial Sequence: Synthetic oligonucleotide
  source 1..12: mol_type = other DNA
aagtgtggttgt

SEQ ID NO: 1837 - DNA, 12 bp, synthetic construct
  misc_feature 1..12: note = Description of Artificial Sequence: Synthetic oligonucleotide
  source 1..12: mol_type = other DNA
gcttgagcttga

SEQ ID NO: 1838 - DNA, 12 bp, synthetic construct
  misc_feature 1..12: note = Description of Artificial Sequence: Synthetic oligonucleotide
  source 1..12: mol_type = other DNA
ctgcatactgag

SEQ ID NO: 1839 - DNA, 12 bp, synthetic construct
  misc_feature 1..12: note = Description of Artificial Sequence: Synthetic oligonucleotide
  source 1..12: mol_type = other DNA
cagcctgcaaat

SEQ ID NO: 1840 - DNA, 12 bp, synthetic construct
  misc_feature 1..12: note = Description of Artificial Sequence: Synthetic oligonucleotide
  source 1..12: mol_type = other DNA
cacgaaagcagg

SEQ ID NO: 1841 - DNA, 12 bp, synthetic construct
  misc_feature 1..12: note = Description of Artificial Sequence: Synthetic oligonucleotide
  source 1..12: mol_type = other DNA
caagtgaaggga

SEQ ID NO: 1842 - DNA, 12 bp, synthetic construct
  misc_feature 1..12: note = Description of Artificial Sequence: Synthetic oligonucleotide
  source 1..12: mol_type = other DNA
cttcgtttcgta

SEQ ID NO: 1843 - DNA, 12 bp, synthetic construct
  misc_feature 1..12: note = Description of Artificial Sequence: Synthetic oligonucleotide
  source 1..12: mol_type = other DNA
cgctgtggatta

SEQ ID NO: 1844 - DNA, 12 bp, synthetic construct
  misc_feature 1..12: note = Description of Artificial Sequence: Synthetic oligonucleotide
  source 1..12: mol_type = other DNA
cagggcctttgt

SEQ ID NO: 1845 - DNA, 12 bp, synthetic construct
  misc_feature 1..12: note = Description of Artificial Sequence: Synthetic oligonucleotide
  source 1..12: mol_type = other DNA
ttgcaagtaccg

SEQ ID NO: 1846 - DNA, 12 bp, synthetic construct
  misc_feature 1..12: note = Description of Artificial Sequence: Synthetic oligonucleotide
  source 1..12: mol_type = other DNA
tcaagtccgcac

SEQ ID NO: 1847 - DNA, 12 bp, synthetic construct
  misc_feature 1..12: note = Description of Artificial Sequence: Synthetic oligonucleotide
  source 1..12: mol_type = other DNA
tgcccatcaggt

SEQ ID NO: 1848 - DNA, 12 bp, synthetic construct
  misc_feature 1..12: note = Description of Artificial Sequence: Synthetic oligonucleotide
  source 1..12: mol_type = other DNA
caccgctcacaa

SEQ ID NO: 1849 - DNA, 12 bp, synthetic construct
  misc_feature 1..12: note = Description of Artificial Sequence: Synthetic oligonucleotide
  source 1..12: mol_type = other DNA
ctgtcagtgacc

SEQ ID NO: 1850 - DNA, 12 bp, synthetic construct
  misc_feature 1..12: note = Description of Artificial Sequence: Synthetic oligonucleotide
  source 1..12: mol_type = other DNA
cgatgaatatcg

SEQ ID NO: 1851 - DNA, 12 bp, synthetic construct
  misc_feature 1..12: note = Description of Artificial Sequence: Synthetic oligonucleotide
  source 1..12: mol_type = other DNA
gcttctctcact

SEQ ID NO: 1852 - DNA, 12 bp, synthetic construct
  misc_feature 1..12: note = Description of Artificial Sequence: Synthetic oligonucleotide
  source 1..12: mol_type = other DNA
tagcacctaaag

SEQ ID NO: 1853 - DNA, 12 bp, synthetic construct
  misc_feature 1..12: note = Description of Artificial Sequence: Synthetic oligonucleotide
  source 1..12: mol_type = other DNA
aggttgctgtaa

SEQ ID NO: 1854 - DNA, 12 bp, synthetic construct
  misc_feature 1..12: note = Description of Artificial Sequence: Synthetic oligonucleotide
  source 1..12: mol_type = other DNA
ctgaacagttgc

SEQ ID NO: 1855 - DNA, 12 bp, synthetic construct
  misc_feature 1..12: note = Description of Artificial Sequence: Synthetic oligonucleotide
  source 1..12: mol_type = other DNA
acgattcgagtc

SEQ ID NO: 1856 - DNA, 12 bp, synthetic construct
  misc_feature 1..12: note = Description of Artificial Sequence: Synthetic oligonucleotide
  source 1..12: mol_type = other DNA
gtcaattagtgg

SEQ ID NO: 1857 - DNA, 12 bp, synthetic construct
  misc_feature 1..12: note = Description of Artificial Sequence: Synthetic oligonucleotide
  source 1..12: mol_type = other DNA
cgagatagtttg

SEQ ID NO: 1858 - DNA, 12 bp, synthetic construct
  misc_feature 1..12: note = Description of Artificial Sequence: Synthetic oligonucleotide
  source 1..12: mol_type = other DNA
gtttcttgttgc

SEQ ID NO: 1859 - DNA, 12 bp, synthetic construct
  misc_feature 1..12: note = Description of Artificial Sequence: Synthetic oligonucleotide
  source 1..12: mol_type = other DNA
taagtactgcag

SEQ ID NO: 1860 - DNA, 12 bp, synthetic construct
  misc_feature 1..12: note = Description of Artificial Sequence: Synthetic oligonucleotide
  source 1..12: mol_type = other DNA
cgctcttaacgg

SEQ ID NO: 1861 - DNA, 12 bp, synthetic construct
  misc_feature 1..12: note = Description of Artificial Sequence: Synthetic oligonucleotide
  source 1..12: mol_type = other DNA
ggttcggtccat

SEQ ID NO: 1862 - DNA, 12 bp, synthetic construct
  misc_feature 1..12: note = Description of Artificial Sequence: Synthetic oligonucleotide
  source 1..12: mol_type = other DNA
agtacgcagtct

SEQ ID NO: 1863 - DNA, 12 bp, synthetic construct
  misc_feature 1..12: note = Description of Artificial Sequence: Synthetic oligonucleotide
  source 1..12: mol_type = other DNA
cgcgtcaaacta

SEQ ID NO: 1864 - DNA, 12 bp, synthetic construct
  misc_feature 1..12: note = Description of Artificial Sequence: Synthetic oligonucleotide
  source 1..12: mol_type = other DNA
acctaaagctgc

SEQ ID NO: 1865 - DNA, 12 bp, synthetic construct
  misc_feature 1..12: note = Description of Artificial Sequence: Synthetic oligonucleotide
  source 1..12: mol_type = other DNA
gccgattgtaac

SEQ ID NO: 1866 - DNA, 12 bp, synthetic construct
  misc_feature 1..12: note = Description of Artificial Sequence: Synthetic oligonucleotide
  source 1..12: mol_type = other DNA
ggagtctcttgc

SEQ ID NO: 1867 - DNA, 12 bp, synthetic construct
  misc_feature 1..12: note = Description of Artificial Sequence: Synthetic oligonucleotide
  source 1..12: mol_type = other DNA
ctgatccatctt

SEQ ID NO: 1868 - DNA, 12 bp, synthetic construct
  misc_feature 1..12: note = Description of Artificial Sequence: Synthetic oligonucleotide
  source 1..12: mol_type = other DNA
agcagctattgc

SEQ ID NO: 1869 - DNA, 12 bp, synthetic construct
  misc_feature 1..12: note = Description of Artificial Sequence: Synthetic oligonucleotide
  source 1..12: mol_type = other DNA
ttgacacacgac

SEQ ID NO: 1870 - DNA, 12 bp, synthetic construct
  misc_feature 1..12: note = Description of Artificial Sequence: Synthetic oligonucleotide
  source 1..12: mol_type = other DNA
accacgatgcta

SEQ ID NO: 1871 - DNA, 12 bp, synthetic construct
  misc_feature 1..12: note = Description of Artificial Sequence: Synthetic oligonucleotide
  source 1..12: mol_type = other DNA
cggtggaagcaa

SEQ ID NO: 1872 - DNA, 12 bp, synthetic construct
  misc_feature 1..12: note = Description of Artificial Sequence: Synthetic oligonucleotide
  source 1..12: mol_type = other DNA
aagttccggcct

SEQ ID NO: 1873 - DNA, 12 bp, synthetic construct
  misc_feature 1..12: note = Description of Artificial Sequence: Synthetic oligonucleotide
  source 1..12: mol_type = other DNA
tatgtgccggct

SEQ ID NO: 1874 - DNA, 12 bp, synthetic construct
  misc_feature 1..12: note = Description of Artificial Sequence: Synthetic oligonucleotide
  source 1..12: mol_type = other DNA
ctcggatagatc

SEQ ID NO: 1875 - DNA, 12 bp, synthetic construct
  misc_feature 1..12: note = Description of Artificial Sequence: Synthetic oligonucleotide
  source 1..12: mol_type = other DNA
ataaggtcgcct

SEQ ID NO: 1876 - DNA, 12 bp, synthetic construct
  misc_feature 1..12: note = Description of Artificial Sequence: Synthetic oligonucleotide
  source 1..12: mol_type = other DNA
gcatctaaagcc

SEQ ID NO: 1877 - DNA, 12 bp, synthetic construct
  misc_feature 1..12: note = Description of Artificial Sequence: Synthetic oligonucleotide
  source 1..12: mol_type = other DNA
gttgaagcacct

SEQ ID NO: 1878 - DNA, 12 bp, synthetic construct
  misc_feature 1..12: note = Description of Artificial Sequence: Synthetic oligonucleotide
  source 1..12: mol_type = other DNA
gcgctgtttaag

SEQ ID NO: 1879 - DNA, 12 bp, synthetic construct
  misc_feature 1..12: note = Description of Artificial Sequence: Synthetic oligonucleotide
  source 1..12: mol_type = other DNA
tggtcgcatcgt

SEQ ID NO: 1880 - DNA, 12 bp, synthetic construct
  misc_feature 1..12: note = Description of Artificial Sequence: Synthetic oligonucleotide
  source 1..12: mol_type = other DNA
ttcccgaaacga

SEQ ID NO: 1881 - DNA, 12 bp, synthetic construct
  misc_feature 1..12: note = Description of Artificial Sequence: Synthetic oligonucleotide
  source 1..12: mol_type = other DNA
ttgccctttgat

SEQ ID NO: 1882 - DNA, 12 bp, synthetic construct
  misc_feature 1..12: note = Description of Artificial Sequence: Synthetic oligonucleotide
  source 1..12: mol_type = other DNA
cgttgacaccca

SEQ ID NO: 1883 - DNA, 12 bp, synthetic construct
  misc_feature 1..12: note = Description of Artificial Sequence: Synthetic oligonucleotide
  source 1..12: mol_type = other DNA
tgtctttacctg

SEQ ID NO: 1884 - DNA, 12 bp, synthetic construct
  misc_feature 1..12: note = Description of Artificial Sequence: Synthetic oligonucleotide
  source 1..12: mol_type = other DNA
gacaattccgaa

SEQ ID NO: 1885 - DNA, 12 bp, synthetic construct
  misc_feature 1..12: note = Description of Artificial Sequence: Synthetic oligonucleotide
  source 1..12: mol_type = other DNA
tgtaagacttgg

SEQ ID NO: 1886 - DNA, 12 bp, synthetic construct
  misc_feature 1..12: note = Description of Artificial Sequence: Synthetic oligonucleotide
  source 1..12: mol_type = other DNA
gaactttagcgc

SEQ ID NO: 1887 - DNA, 12 bp, synthetic construct
  misc_feature 1..12: note = Description of Artificial Sequence: Synthetic oligonucleotide
  source 1..12: mol_type = other DNA
cctggaattaag

SEQ ID NO: 1888 - DNA, 12 bp, synthetic construct
  misc_feature 1..12: note = Description of Artificial Sequence: Synthetic oligonucleotide
  source 1..12: mol_type = other DNA
cttgggttaggt

SEQ ID NO: 1889 - DNA, 12 bp, synthetic construct
  misc_feature 1..12: note = Description of Artificial Sequence: Synthetic oligonucleotide
  source 1..12: mol_type = other DNA
ccttgttcacct

SEQ ID NO: 1890 - DNA, 12 bp, synthetic construct
  misc_feature 1..12: note = Description of Artificial Sequence: Synthetic oligonucleotide
  source 1..12: mol_type = other DNA
aggtctcccgat

SEQ ID NO: 1891 - DNA, 12 bp, synthetic construct
  misc_feature 1..12: note = Description of Artificial Sequence: Synthetic oligonucleotide
  source 1..12: mol_type = other DNA
cggatctagtgt

SEQ ID NO: 1892 - DNA, 12 bp, synthetic construct
  misc_feature 1..12: note = Description of Artificial Sequence: Synthetic oligonucleotide
  source 1..12: mol_type = other DNA
tccttagaaggc

SEQ ID NO: 1893 - DNA, 12 bp, synthetic construct
  misc_feature 1..12: note = Description of Artificial Sequence: Synthetic oligonucleotide
  source 1..12: mol_type = other DNA
tgagaccctaca

SEQ ID NO: 1894 - DNA, 12 bp, synthetic construct
  misc_feature 1..12: note = Description of Artificial Sequence: Synthetic oligonucleotide
  source 1..12: mol_type = other DNA
ctacgtgaaatg

SEQ ID NO: 1895 - DNA, 12 bp, synthetic construct
  misc_feature 1..12: note = Description of Artificial Sequence: Synthetic oligonucleotide
  source 1..12: mol_type = other DNA
caaccactcggt

SEQ ID NO: 1896 - DNA, 12 bp, synthetic construct
  misc_feature 1..12: note = Description of Artificial Sequence: Synthetic oligonucleotide
  source 1..12: mol_type = other DNA
acgatggttgat

SEQ ID NO: 1897 - DNA, 12 bp, synthetic construct
  misc_feature 1..12: note = Description of Artificial Sequence: Synthetic oligonucleotide
  source 1..12: mol_type = other DNA
cgatcttcgagc

SEQ ID NO: 1898 - DNA, 12 bp, synthetic construct
  misc_feature 1..12: note = Description of Artificial Sequence: Synthetic oligonucleotide
  source 1..12: mol_type = other DNA
gatggacttcaa

SEQ ID NO: 1899 - DNA, 12 bp, synthetic construct
  misc_feature 1..12: note = Description of Artificial Sequence: Synthetic oligonucleotide
  source 1..12: mol_type = other DNA
aagtatcctgcg

SEQ ID NO: 1900 - DNA, 12 bp, synthetic construct
  misc_feature 1..12: note = Description of Artificial Sequence: Synthetic oligonucleotide
  source 1..12: mol_type = other DNA
gccagcttcatg

SEQ ID NO: 1901 - DNA, 12 bp, synthetic construct
  misc_feature 1..12: note = Description of Artificial Sequence: Synthetic oligonucleotide
  source 1..12: mol_type = other DNA
tcttagtcgggc

SEQ ID NO: 1902 - DNA, 12 bp, synthetic construct
  misc_feature 1..12: note = Description of Artificial Sequence: Synthetic oligonucleotide
  source 1..12: mol_type = other DNA
agacttctcagg

SEQ ID NO: 1903 - DNA, 12 bp, synthetic construct
  misc_feature 1..12: note = Description of Artificial Sequence: Synthetic oligonucleotide
  source 1..12: mol_type = other DNA
gtcgaatttgcg

SEQ ID NO: 1904 - DNA, 12 bp, synthetic construct
  misc_feature 1..12: note = Description of Artificial Sequence: Synthetic oligonucleotide
  source 1..12: mol_type = other DNA
tactgagcctcg

SEQ ID NO: 1905 - DNA, 12 bp, synthetic construct
  misc_feature 1..12: note = Description of Artificial Sequence: Synthetic oligonucleotide
  source 1..12: mol_type = other DNA
caaatggtcgtc

SEQ ID NO: 1906 - DNA, 12 bp, synthetic construct
  misc_feature 1..12: note = Description of Artificial Sequence: Synthetic oligonucleotide
  source 1..12: mol_type = other DNA
gtgcattcgcca

SEQ ID NO: 1907 - DNA, 12 bp, synthetic construct
  misc_feature 1..12: note = Description of Artificial Sequence: Synthetic oligonucleotide
  source 1..12: mol_type = other DNA
gtaccgttgcaa

SEQ ID NO: 1908 - DNA, 12 bp, synthetic construct
  misc_feature 1..12: note = Description of Artificial Sequence: Synthetic oligonucleotide
  source 1..12: mol_type = other DNA
ggatgtcttcgc

SEQ ID NO: 1909 - DNA, 12 bp, synthetic construct
  misc_feature 1..12: note = Description of Artificial Sequence: Synthetic oligonucleotide
  source 1..12: mol_type = other DNA
gcatcagagtta

SEQ ID NO: 1910 - DNA, 12 bp, synthetic construct
  misc_feature 1..12: note = Description of Artificial Sequence: Synthetic oligonucleotide
  source 1..12: mol_type = other DNA
agaaggccttat

SEQ ID NO: 1911 - DNA, 12 bp, synthetic construct
  misc_feature 1..12: note = Description of Artificial Sequence: Synthetic oligonucleotide
  source 1..12: mol_type = other DNA
acacataagtcg

SEQ ID NO: 1912 - DNA, 12 bp, synthetic construct
  misc_feature 1..12: note = Description of Artificial Sequence: Synthetic oligonucleotide
  source 1..12: mol_type = other DNA
tgagagtccctc

SEQ ID NO: 1913 - DNA, 12 bp, synthetic construct
  misc_feature 1..12: note = Description of Artificial Sequence: Synthetic oligonucleotide
  source 1..12: mol_type = other DNA
ctgatagcacac

SEQ ID NO: 1914 - DNA, 12 bp, synthetic construct
  misc_feature 1..12: note = Description of Artificial Sequence: Synthetic oligonucleotide
  source 1..12: mol_type = other DNA
tcctgaacacag

SEQ ID NO: 1915 - DNA, 12 bp, synthetic construct
  misc_feature 1..12: note = Description of Artificial Sequence: Synthetic oligonucleotide
  source 1..12: mol_type = other DNA
gtggtcatcgta

SEQ ID NO: 1916 - DNA, 12 bp, synthetic construct
  misc_feature 1..12: note = Description of Artificial Sequence: Synthetic oligonucleotide
  source 1..12: mol_type = other DNA
tggagccttgtc

SEQ ID NO: 1917 - DNA, 12 bp, synthetic construct
  misc_feature 1..12: note = Description of Artificial Sequence: Synthetic oligonucleotide
  source 1..12: mol_type = other DNA
tactgccagtga

SEQ ID NO: 1918 - DNA, 12 bp, synthetic construct
  misc_feature 1..12: note = Description of Artificial Sequence: Synthetic oligonucleotide
  source 1..12: mol_type = other DNA
ctctgtagccga

SEQ ID NO: 1919 - DNA, 12 bp, synthetic construct
  misc_feature 1..12: note = Description of Artificial Sequence: Synthetic oligonucleotide
  source 1..12: mol_type = other DNA
acaggtagagag

SEQ ID NO: 1920 - DNA, 12 bp, synthetic construct
  misc_feature 1..12: note = Description of Artificial Sequence: Synthetic oligonucleotide
  source 1..12: mol_type = other DNA
aagcctctacga

SEQ ID NO: 1921 - DNA, 12 bp, synthetic construct
  misc_feature 1..12: note = Description of Artificial Sequence: Synthetic oligonucleotide
  source 1..12: mol_type = other DNA
ctgaagggcgaa

SEQ ID NO: 1922 - DNA, 12 bp, synthetic construct
  misc_feature 1..12: note = Description of Artificial Sequence: Synthetic oligonucleotide
  source 1..12: mol_type = other DNA
ctcgatgtaagc

SEQ ID NO: 1923 - DNA, 12 bp, synthetic construct
  misc_feature 1..12: note = Description of Artificial Sequence: Synthetic oligonucleotide
  source 1..12: mol_type = other DNA
gagtttacggtc

SEQ ID NO: 1924 - DNA, 12 bp, synthetic construct
  misc_feature 1..12: note = Description of Artificial Sequence: Synthetic oligonucleotide
  source 1..12: mol_type = other DNA
gcagtaactgtc

SEQ ID NO: 1925 - DNA, 12 bp, synthetic construct
  misc_feature 1..12: note = Description of Artificial Sequence: Synthetic oligonucleotide
  source 1..12: mol_type = other DNA
tgctcacgtgtg

SEQ ID NO: 1926 - DNA, 12 bp, synthetic construct
  misc_feature 1..12: note = Description of Artificial Sequence: Synthetic oligonucleotide
  source 1..12: mol_type = other DNA
tacttgccacgg

SEQ ID NO: 1927 - DNA, 12 bp, synthetic construct
  misc_feature 1..12: note = Description of Artificial Sequence: Synthetic oligonucleotide
  source 1..12: mol_type = other DNA
cgctcacagaat

SEQ ID NO: 1928 - DNA, 12 bp, synthetic construct
  misc_feature 1..12: note = Description of Artificial Sequence: Synthetic oligonucleotide
  source 1..12: mol_type = other DNA
agcttcgacagt

SEQ ID NO: 1929 - DNA, 12 bp, synthetic construct
  misc_feature 1..12: note = Description of Artificial Sequence: Synthetic oligonucleotide
  source 1..12: mol_type = other DNA
ggcacaccctta

SEQ ID NO: 1930 - DNA, 12 bp, synthetic construct
  misc_feature 1..12: note = Description of Artificial Sequence: Synthetic oligonucleotide
  source 1..12: mol_type = other DNA
catatagcccga

SEQ ID NO: 1931 - DNA, 12 bp, synthetic construct
  misc_feature 1..12: note = Description of Artificial Sequence: Synthetic oligonucleotide
  source 1..12: mol_type = other DNA
gtaataatgccg

SEQ ID NO: 1932 - DNA, 12 bp, synthetic construct
  misc_feature 1..12: note = Description of Artificial Sequence: Synthetic oligonucleotide
  source 1..12: mol_type = other DNA
gcataaacgact

SEQ ID NO: 1933 - DNA, 12 bp, synthetic construct
  misc_feature 1..12: note = Description of Artificial Sequence: Synthetic oligonucleotide
  source 1..12: mol_type = other DNA
attcggtagtgc

SEQ ID NO: 1934 - DNA, 12 bp, synthetic construct
  misc_feature 1..12: note = Description of Artificial Sequence: Synthetic oligonucleotide
  source 1..12: mol_type = other DNA
atacgcatcaag

SEQ ID NO: 1935 - DNA, 12 bp, synthetic construct
  misc_feature 1..12: note = Description of Artificial Sequence: Synthetic oligonucleotide
  source 1..12: mol_type = other DNA
gtccagctatga

SEQ ID NO: 1936 - DNA, 12 bp, synthetic construct
  misc_feature 1..12: note = Description of Artificial Sequence: Synthetic oligonucleotide
  source 1..12: mol_type = other DNA
cagtgcacgtct

SEQ ID NO: 1937 - DNA, 12 bp, synthetic construct
  misc_feature 1..12: note = Description of Artificial Sequence: Synthetic oligonucleotide
  source 1..12: mol_type = other DNA
ctcggcaccaat

SEQ ID NO: 1938 - DNA, 12 bp, synthetic construct
  misc_feature 1..12: note = Description of Artificial Sequence: Synthetic oligonucleotide
  source 1..12: mol_type = other DNA
ctttgcactttg

SEQ ID NO: 1939 - DNA, 12 bp, synthetic construct
  misc_feature 1..12: note = Description of Artificial Sequence: Synthetic oligonucleotide
  source 1..12: mol_type = other DNA
cgagctgttacc

SEQ ID NO: 1940 - DNA, 12 bp, synthetic construct
  misc_feature 1..12: note = Description of Artificial Sequence: Synthetic oligonucleotide
  source 1..12: mol_type = other DNA
agatgtccgtca

SEQ ID NO: 1941 - DNA, 12 bp, synthetic construct
  misc_feature 1..12: note = Description of Artificial Sequence: Synthetic oligonucleotide
  source 1..12: mol_type = other DNA
tcgcgcaactgt

SEQ ID NO: 1942 - DNA, 12 bp, synthetic construct
  misc_feature 1..12: note = Description of Artificial Sequence: Synthetic oligonucleotide
  source 1..12: mol_type = other DNA
caagactgacct

SEQ ID NO: 1943 - DNA, 12 bp, synthetic construct
  misc_feature 1..12: note = Description of Artificial Sequence: Synthetic oligonucleotide
  source 1..12: mol_type = other DNA
actcgaaaccaa

SEQ ID NO: 1944 - DNA, 12 bp, synthetic construct
  misc_feature 1..12: note = Description of Artificial Sequence: Synthetic oligonucleotide
  source 1..12: mol_type = other DNA
tgacacgacatc

SEQ ID NO: 1945 - DNA, 12 bp, synthetic construct
  misc_feature 1..12: note = Description of Artificial Sequence: Synthetic oligonucleotide
  source 1..12: mol_type = other DNA
caacacatgctg

SEQ ID NO: 1946 - DNA, 12 bp, synthetic construct
  misc_feature 1..12: note = Description of Artificial Sequence: Synthetic oligonucleotide
  source 1..12: mol_type = other DNA
gcacctgttgaa

SEQ ID NO: 1947 - DNA, 12 bp, synthetic construct
  misc_feature 1..12: note = Description of Artificial Sequence: Synthetic oligonucleotide
  source 1..12: mol_type = other DNA
attcctctccac

SEQ ID NO: 1948 - DNA, 12 bp, synthetic construct
  misc_feature 1..12: note = Description of Artificial Sequence: Synthetic oligonucleotide
  source 1..12: mol_type = other DNA
ccgataaaggtt

SEQ ID NO: 1949 - DNA, 12 bp, synthetic construct
  misc_feature 1..12: note = Description of Artificial Sequence: Synthetic oligonucleotide
  source 1..12: mol_type = other DNA
accgtaagacat

SEQ ID NO: 1950 - DNA, 12 bp, synthetic construct
  misc_feature 1..12: note = Description of Artificial Sequence: Synthetic oligonucleotide
  source 1..12: mol_type = other DNA
tgttgacgatgc

SEQ ID NO: 1951 - DNA, 12 bp, synthetic construct
  misc_feature 1..12: note = Description of Artificial Sequence: Synthetic oligonucleotide
  source 1..12: mol_type = other DNA
attctctcacgt

SEQ ID NO: 1952 - DNA, 12 bp, synthetic construct
  misc_feature 1..12: note = Description of Artificial Sequence: Synthetic oligonucleotide
  source 1..12: mol_type = other DNA
cctagagaaact

SEQ ID NO: 1953 - DNA, 12 bp, synthetic construct
  misc_feature 1..12: note = Description of Artificial Sequence: Synthetic oligonucleotide
  source 1..12: mol_type = other DNA
tggttcatcctt

SEQ ID NO: 1954 - DNA, 12 bp, synthetic construct
  misc_feature 1..12: note = Description of Artificial Sequence: Synthetic oligonucleotide
  source 1..12: mol_type = other DNA
ctttgtcagggc

SEQ ID NO: 1955 - DNA, 12 bp, synthetic construct
  misc_feature 1..12: note = Description of Artificial Sequence: Synthetic oligonucleotide
  source 1..12: mol_type = other DNA
atcacgggagag

SEQ ID NO: 1956 - DNA, 12 bp, synthetic construct
  misc_feature 1..12: note = Description of Artificial Sequence: Synthetic oligonucleotide
  source 1..12: mol_type = other DNA
gacaagaaggtg

SEQ ID NO: 1957 - DNA, 12 bp, synthetic construct
  misc_feature 1..12: note = Description of Artificial Sequence: Synthetic oligonucleotide
  source 1..12: mol_type = other DNA
cgactctaaacg

SEQ ID NO: 1958 - DNA, 12 bp, synthetic construct
  misc_feature 1..12: note = Description of Artificial Sequence: Synthetic oligonucleotide
  source 1..12: mol_type = other DNA
gaggttcttgac

SEQ ID NO: 1959 - DNA, 12 bp, synthetic construct
  misc_feature 1..12: note = Description of Artificial Sequence: Synthetic oligonucleotide
  source 1..12: mol_type = other DNA
agcactttgaga

SEQ ID NO: 1960 - DNA, 12 bp, synthetic construct
  misc_feature 1..12: note = Description of Artificial Sequence: Synthetic oligonucleotide
  source 1..12: mol_type = other DNA
tccgaagacaat

SEQ ID NO: 1961 - DNA, 12 bp, synthetic construct
  misc_feature 1..12: note = Description of Artificial Sequence: Synthetic oligonucleotide
  source 1..12: mol_type = other DNA
tcactgctagga

SEQ ID NO: 1962 - DNA, 12 bp, synthetic construct
  misc_feature 1..12: note = Description of Artificial Sequence: Synthetic oligonucleotide
  source 1..12: mol_type = other DNA
gagtgctctaac

SEQ ID NO: 1963 - DNA, 12 bp, synthetic construct
  misc_feature 1..12: note = Description of Artificial Sequence: Synthetic oligonucleotide
  source 1..12: mol_type = other DNA
gtcttcagcaag

SEQ ID NO: 1964 - DNA, 12 bp, synthetic construct
  misc_feature 1..12: note = Description of Artificial Sequence: Synthetic oligonucleotide
  source 1..12: mol_type = other DNA
ctgtaaaggttg

SEQ ID NO: 1965 - DNA, 12 bp, synthetic construct
  misc_feature 1..12: note = Description of Artificial Sequence: Synthetic oligonucleotide
  source 1..12: mol_type = other DNA
ccacggtacttg

SEQ ID NO: 1966 - DNA, 12 bp, synthetic construct
  misc_feature 1..12: note = Description of Artificial Sequence: Synthetic oligonucleotide
  source 1..12: mol_type = other DNA
acttcggatgca

SEQ ID NO: 1967 - DNA, 12 bp, synthetic construct
  misc_feature 1..12: note = Description of Artificial Sequence: Synthetic oligonucleotide
  source 1..12: mol_type = other DNA
ctaatcagagtg

SEQ ID NO: 1968 - DNA, 12 bp, synthetic construct
  misc_feature 1..12: note = Description of Artificial Sequence: Synthetic oligonucleotide
  source 1..12: mol_type = other DNA
ttgtgtctccct

SEQ ID NO: 1969 - DNA, 12 bp, synthetic construct
  misc_feature 1..12: note = Description of Artificial Sequence: Synthetic oligonucleotide
  source 1..12: mol_type = other DNA
cggataacctcc

SEQ ID NO: 1970 - DNA, 12 bp, synthetic construct
  misc_feature 1..12: note = Description of Artificial Sequence: Synthetic oligonucleotide
  source 1..12: mol_type = other DNA
tgagtcattgag

SEQ ID NO: 1971 - DNA, 12 bp, synthetic construct
  misc_feature 1..12: note = Description of Artificial Sequence: Synthetic oligonucleotide
  source 1..12: mol_type = other DNA
actagttggacc

SEQ ID NO: 1972 - DNA, 12 bp, synthetic construct
  misc_feature 1..12: note = Description of Artificial Sequence: Synthetic oligonucleotide
  source 1..12: mol_type = other DNA
taacatcaggca

SEQ ID NO: 1973 - DNA, 12 bp, synthetic construct
  misc_feature 1..12: note = Description of Artificial Sequence: Synthetic oligonucleotide
  source 1..12: mol_type = other DNA
ttggcattggca

SEQ ID NO: 1974 - DNA, 12 bp, synthetic construct
  misc_feature 1..12: note = Description of Artificial Sequence: Synthetic oligonucleotide
  source 1..12: mol_type = other DNA
cgttaccggact

SEQ ID NO: 1975 - DNA, 12 bp, synthetic construct
  misc_feature 1..12: note = Description of Artificial Sequence: Synthetic oligonucleotide
  source 1..12: mol_type = other DNA
agggtgacttta

SEQ ID NO: 1976 - DNA, 12 bp, synthetic construct
  misc_feature 1..12: note = Description of Artificial Sequence: Synthetic oligonucleotide
  source 1..12: mol_type = other DNA
tacggcagttca

SEQ ID NO: 1977 - DNA, 12 bp, synthetic construct
  misc_feature 1..12: note = Description of Artificial Sequence: Synthetic oligonucleotide
  source 1..12: mol_type = other DNA
gatcaacccaca

SEQ ID NO: 1978 - DNA, 12 bp, synthetic construct
  misc_feature 1..12: note = Description of Artificial Sequence: Synthetic oligonucleotide
  source 1..12: mol_type = other DNA
taatgagatgcc

SEQ ID NO: 1979 - DNA, 12 bp, synthetic construct
  misc_feature 1..12: note = Description of Artificial Sequence: Synthetic oligonucleotide
  source 1..12: mol_type = other DNA
tataatccgagg

SEQ ID NO: 1980 - DNA, 12 bp, synthetic construct
  misc_feature 1..12: note = Description of Artificial Sequence: Synthetic oligonucleotide
  source 1..12: mol_type = other DNA
tgtgcacgccat

SEQ ID NO: 1981 - DNA, 12 bp, synthetic construct
  misc_feature 1..12: note = Description of Artificial Sequence: Synthetic oligonucleotide
  source 1..12: mol_type = other DNA
gacttcatgcga

SEQ ID NO: 1982 - DNA, 12 bp, synthetic construct
  misc_feature 1..12: note = Description of Artificial Sequence: Synthetic oligonucleotide
  source 1..12: mol_type = other DNA
ctctagaagagt

SEQ ID NO: 1983 - DNA, 12 bp, synthetic construct
  misc_feature 1..12: note = Description of Artificial Sequence: Synthetic oligonucleotide
  source 1..12: mol_type = other DNA
atgcgagacttc

SEQ ID NO: 1984 - DNA, 12 bp, synthetic construct
  misc_feature 1..12: note = Description of Artificial Sequence: Synthetic oligonucleotide
  source 1..12: mol_type = other DNA
atcggtggaatt

SEQ ID NO: 1985 - DNA, 12 bp, synthetic construct
  misc_feature 1..12: note = Description of Artificial Sequence: Synthetic oligonucleotide
  source 1..12: mol_type = other DNA
tccagatagcgt

SEQ ID NO: 1986 - DNA, 12 bp, synthetic construct
  misc_feature 1..12: note = Description of Artificial Sequence: Synthetic oligonucleotide
  source 1..12: mol_type = other DNA
tcccagaagctc

SEQ ID NO: 1987 - DNA, 12 bp, synthetic construct
  misc_feature 1..12: note = Description of Artificial Sequence: Synthetic oligonucleotide
  source 1..12: mol_type = other DNA
gcctgtctgcaa

SEQ ID NO: 1988 - DNA, 12 bp, synthetic construct
  misc_feature 1..12: note = Description of Artificial Sequence: Synthetic oligonucleotide
  source 1..12: mol_type = other DNA
tgcacagtcgct

SEQ ID NO: 1989 - DNA, 12 bp, synthetic construct
  misc_feature 1..12: note = Description of Artificial Sequence: Synthetic oligonucleotide
  source 1..12: mol_type = other DNA
cgcttgtgtagc

SEQ ID NO: 1990 - DNA, 12 bp, synthetic construct
  misc_feature 1..12: note = Description of Artificial Sequence: Synthetic oligonucleotide
  source 1..12: mol_type = other DNA
tatagtgggcct

SEQ ID NO: 1991 - DNA, 12 bp, synthetic construct
  misc_feature 1..12: note = Description of Artificial Sequence: Synthetic oligonucleotide
  source 1..12: mol_type = other DNA
aatccggtcacc

SEQ ID NO: 1992 - DNA, 12 bp, synthetic construct
  misc_feature 1..12: note = Description of Artificial Sequence: Synthetic oligonucleotide
  source 1..12: mol_type = other DNA
acgctagattga

SEQ ID NO: 1993 - DNA, 12 bp, synthetic construct
  misc_feature 1..12: note = Description of Artificial Sequence: Synthetic oligonucleotide
  source 1..12: mol_type = other DNA
actgatggcctc

SEQ ID NO: 1994 - DNA, 12 bp, synthetic construct
  misc_feature 1..12: note = Description of Artificial Sequence: Synthetic oligonucleotide
  source 1..12: mol_type = other DNA
catgcggatcct

SEQ ID NO: 1995 - DNA, 12 bp, synthetic construct
  misc_feature 1..12: note = Description of Artificial Sequence: Synthetic oligonucleotide
  source 1..12: mol_type = other DNA
atgaatgcgtcc

SEQ ID NO: 1996 - DNA, 12 bp, synthetic construct
  misc_feature 1..12: note = Description of Artificial Sequence: Synthetic oligonucleotide
  source 1..12: mol_type = other DNA
tcgacggagaga

SEQ ID NO: 1997 - DNA, 12 bp, synthetic construct
  misc_feature 1..12: note = Description of Artificial Sequence: Synthetic oligonucleotide
  source 1..12: mol_type = other DNA
aagtgcttggta

SEQ ID NO: 1998 - DNA, 12 bp, synthetic construct
  misc_feature 1..12: note = Description of Artificial Sequence: Synthetic oligonucleotide
  source 1..12: mol_type = other DNA
ttacggctggtc

SEQ ID NO: 1999 - DNA, 12 bp, synthetic construct
  misc_feature 1..12: note = Description of Artificial Sequence: Synthetic oligonucleotide
  source 1..12: mol_type = other DNA
ttcgatgccgca

SEQ ID NO: 2000 - DNA, 12 bp, synthetic construct
  misc_feature 1..12: note = Description of Artificial Sequence: Synthetic oligonucleotide
  source 1..12: mol_type = other DNA
tgctccgtagaa

SEQ ID NO: 2001 - DNA, 12 bp, synthetic construct
  misc_feature 1..12: note = Description of Artificial Sequence: Synthetic oligonucleotide
  source 1..12: mol_type = other DNA
gactctgctcag

SEQ ID NO: 2002 - DNA, 12 bp, synthetic construct
  misc_feature 1..12: note = Description of Artificial Sequence: Synthetic oligonucleotide
  source 1..12: mol_type = other DNA
atctgacatcgg

SEQ ID NO: 2003 - DNA, 12 bp, synthetic construct
  misc_feature 1..12: note = Description of Artificial Sequence: Synthetic oligonucleotide
  source 1..12: mol_type = other DNA
ggtaaagggtcg

SEQ ID NO: 2004 - DNA, 12 bp, synthetic construct
  misc_feature 1..12: note = Description of Artificial Sequence: Synthetic oligonucleotide
  source 1..12: mol_type = other DNA
tgcaatggtacc

SEQ ID NO: 2005 - DNA, 12 bp, synthetic construct
  misc_feature 1..12: note = Description of Artificial Sequence: Synthetic oligonucleotide
  source 1..12: mol_type = other DNA
tgtggctcgtgt

SEQ ID NO: 2006 - DNA, 12 bp, synthetic construct
  misc_feature 1..12: note = Description of Artificial Sequence: Synthetic oligonucleotide
  source 1..12: mol_type = other DNA
tgataggtacac

SEQ ID NO: 2007 - DNA, 12 bp, synthetic construct
  misc_feature 1..12: note = Description of Artificial Sequence: Synthetic oligonucleotide
  source 1..12: mol_type = other DNA
cacgtacacgta

SEQ ID NO: 2008 - DNA, 12 bp, synthetic construct
  misc_feature 1..12: note = Description of Artificial Sequence: Synthetic oligonucleotide
  source 1..12: mol_type = other DNA
gatagggccaag

SEQ ID NO: 2009 - DNA, 12 bp, synthetic construct
  misc_feature 1..12: note = Description of Artificial Sequence: Synthetic oligonucleotide
  source 1..12: mol_type = other DNA
gctttctcaatc

SEQ ID NO: 2010 - DNA, 12 bp, synthetic construct
  misc_feature 1..12: note = Description of Artificial Sequence: Synthetic oligonucleotide
  source 1..12: mol_type = other DNA
aacaggtctctg

SEQ ID NO: 2011 - DNA, 12 bp, synthetic construct
  misc_feature 1..12: note = Description of Artificial Sequence: Synthetic oligonucleotide
  source 1..12: mol_type = other DNA
aactttcaggag

SEQ ID NO: 2012 - DNA, 12 bp, synthetic construct
  misc_feature 1..12: note = Description of Artificial Sequence: Synthetic oligonucleotide
  source 1..12: mol_type = other DNA
cgagttcatcga

SEQ ID NO: 2013 - DNA, 12 bp, synthetic construct
  misc_feature 1..12: note = Description of Artificial Sequence: Synthetic oligonucleotide
  source 1..12: mol_type = other DNA
cagagctaattg

SEQ ID NO: 2014 - DNA, 12 bp, synthetic construct
  misc_feature 1..12: note = Description of Artificial Sequence: Synthetic oligonucleotide
  source 1..12: mol_type = other DNA
cgggcttcatca

SEQ ID NO: 2015 - DNA, 12 bp, synthetic construct
  misc_feature 1..12: note = Description of Artificial Sequence: Synthetic oligonucleotide
  source 1..12: mol_type = other DNA
acagtgcgtcct

SEQ ID NO: 2016 - DNA, 12 bp, synthetic construct
  misc_feature 1..12: note = Description of Artificial Sequence: Synthetic oligonucleotide
  source 1..12: mol_type = other DNA
gtgctaataggt

SEQ ID NO: 2017 - DNA, 12 bp, synthetic construct
  misc_feature 1..12: note = Description of Artificial Sequence: Synthetic oligonucleotide
  source 1..12: mol_type = other DNA
tgcacgtgataa

SEQ ID NO: 2018 - DNA, 12 bp, synthetic construct
  misc_feature 1..12: note = Description of Artificial Sequence: Synthetic oligonucleotide
  source 1..12: mol_type = other DNA
aagcagattgtc

SEQ ID NO: 2019 - DNA, 12 bp, synthetic construct
  misc_feature 1..12: note = Description of Artificial Sequence: Synthetic oligonucleotide
  source 1..12: mol_type = other DNA
ttatccagtcct

SEQ ID NO: 2020 - DNA, 12 bp, synthetic construct
  misc_feature 1..12: note = Description of Artificial Sequence: Synthetic oligonucleotide
  source 1..12: mol_type = other DNA
cgtaacgtaatg

SEQ ID NO: 2021 - DNA, 12 bp, synthetic construct
  misc_feature 1..12: note = Description of Artificial Sequence: Synthetic oligonucleotide
  source 1..12: mol_type = other DNA
taggaactcacc

SEQ ID NO: 2022 - DNA, 12 bp, synthetic construct
  misc_feature 1..12: note = Description of Artificial Sequence: Synthetic oligonucleotide
  source 1..12: mol_type = other DNA
gcgatcacacct

SEQ ID NO: 2023 - DNA, 12 bp, synthetic construct
  misc_feature 1..12: note = Description of Artificial Sequence: Synthetic oligonucleotide
  source 1..12: mol_type = other DNA
gttcggtgtcca

SEQ ID NO: 2024 - DNA, 12 bp, synthetic construct
  misc_feature 1..12: note = Description of Artificial Sequence: Synthetic oligonucleotide
  source 1..12: mol_type = other DNA
tagaggcgtagg

SEQ ID NO: 2025 - DNA, 12 bp, synthetic construct
  misc_feature 1..12: note = Description of Artificial Sequence: Synthetic oligonucleotide
  source 1..12: mol_type = other DNA
ctaagacgtcgt

SEQ ID NO: 2026 - DNA, 12 bp, synthetic construct
  misc_feature 1..12: note = Description of Artificial Sequence: Synthetic oligonucleotide
  source 1..12: mol_type = other DNA
tagcgacctcac

SEQ ID NO: 2027 - DNA, 12 bp, synthetic construct
  misc_feature 1..12: note = Description of Artificial Sequence: Synthetic oligonucleotide
  source 1..12: mol_type = other DNA
tgtattggacag

SEQ ID NO: 2028 - DNA, 12 bp, synthetic construct
  misc_feature 1..12: note = Description of Artificial Sequence: Synthetic oligonucleotide
  source 1..12: mol_type = other DNA
aatggaccgttc

SEQ ID NO: 2029 - DNA, 12 bp, synthetic construct
  misc_feature 1..12: note = Description of Artificial Sequence: Synthetic oligonucleotide
  source 1..12: mol_type = other DNA
aagacagctatc

SEQ ID NO: 2030 - DNA, 12 bp, synthetic construct
  misc_feature 1..12: note = Description of Artificial Sequence: Synthetic oligonucleotide
  source 1..12: mol_type = other DNA
tcagcgccgtta

SEQ ID NO: 2031 - DNA, 12 bp, synthetic construct
  misc_feature 1..12: note = Description of Artificial Sequence: Synthetic oligonucleotide
  source 1..12: mol_type = other DNA
ggctcagattcc

SEQ ID NO: 2032 - DNA, 12 bp, synthetic construct
  misc_feature 1..12: note = Description of Artificial Sequence: Synthetic oligonucleotide
  source 1..12: mol_type = other DNA
accctgggtatc

SEQ ID NO: 2033 - DNA, 12 bp, synthetic construct
  misc_feature 1..12: note = Description of Artificial Sequence: Synthetic oligonucleotide
  source 1..12: mol_type = other DNA
agaaagggtgtg

SEQ ID NO: 2034 - DNA, 12 bp, synthetic construct
  misc_feature 1..12: note = Description of Artificial Sequence: Synthetic oligonucleotide
  source 1..12: mol_type = other DNA
gtacgtcactga

SEQ ID NO: 2035 - DNA, 12 bp, synthetic construct
  misc_feature 1..12: note = Description of Artificial Sequence: Synthetic oligonucleotide
  source 1..12: mol_type = other DNA
attgaccggtca

SEQ ID NO: 2036 - DNA, 12 bp, synthetic construct
  misc_feature 1..12: note = Description of Artificial Sequence: Synthetic oligonucleotide
  source 1..12: mol_type = other DNA
tagaccgactcc

SEQ ID NO: 2037 - DNA, 12 bp, synthetic construct
  misc_feature 1..12: note = Description of Artificial Sequence: Synthetic oligonucleotide
  source 1..12: mol_type = other DNA
cttggtagtgcc

SEQ ID NO: 2038 - DNA, 12 bp, synthetic construct
  misc_feature 1..12: note = Description of Artificial Sequence: Synthetic oligonucleotide
  source 1..12: mol_type = other DNA
agcgagaagtga

SEQ ID NO: 2039 - DNA, 12 bp, synthetic construct
  misc_feature 1..12: note = Description of Artificial Sequence: Synthetic oligonucleotide
  source 1..12: mol_type = other DNA
gctcacaatgtg

SEQ ID NO: 2040 - DNA, 12 bp, synthetic construct
  misc_feature 1..12: note = Description of Artificial Sequence: Synthetic oligonucleotide
  source 1..12: mol_type = other DNA
tagcctgtcgtg

SEQ ID NO: 2041 - DNA, 12 bp, synthetic construct
  misc_feature 1..12: note = Description of Artificial Sequence: Synthetic oligonucleotide
  source 1..12: mol_type = other DNA
ttctccatcaca

SEQ ID NO: 2042 - DNA, 12 bp, synthetic construct
  misc_feature 1..12: note = Description of Artificial Sequence: Synthetic oligonucleotide
  source 1..12: mol_type = other DNA
gtcaacgctgtc

SEQ ID NO: 2043 - DNA, 12 bp, synthetic construct
  misc_feature 1..12: note = Description of Artificial Sequence: Synthetic oligonucleotide
  source 1..12: mol_type = other DNA
gtgctgcgctta

SEQ ID NO: 2044 - DNA, 12 bp, synthetic construct
  misc_feature 1..12: note = Description of Artificial Sequence: Synthetic oligonucleotide
  source 1..12: mol_type = other DNA
cttcaagatgga

SEQ ID NO: 2045 - DNA, 12 bp, synthetic construct
  misc_feature 1..12: note = Description of Artificial Sequence: Synthetic oligonucleotide
  source 1..12: mol_type = other DNA
tattgcagcagc

SEQ ID NO: 2046 - DNA, 12 bp, synthetic construct
  misc_feature 1..12: note = Description of Artificial Sequence: Synthetic oligonucleotide
  source 1..12: mol_type = other DNA
acagacgacgga

SEQ ID NO: 2047 - DNA, 12 bp, synthetic construct
  misc_feature 1..12: note = Description of Artificial Sequence: Synthetic oligonucleotide
  source 1..12: mol_type = other DNA
cgtaggtagagg

SEQ ID NO: 2048 - DNA, 12 bp, synthetic construct
  misc_feature 1..12: note = Description of Artificial Sequence: Synthetic oligonucleotide
  source 1..12: mol_type = other DNA
acaggagggtgt

SEQ ID NO: 2049 - DNA, 12 bp, synthetic construct
  misc_feature 1..12: note = Description of Artificial Sequence: Synthetic oligonucleotide
  source 1..12: mol_type = other DNA
agtaggaggcac

SEQ ID NO: 2050 - DNA, 12 bp, synthetic construct
  misc_feature 1..12: note = Description of Artificial Sequence: Synthetic oligonucleotide
  source 1..12: mol_type = other DNA
gctgcgtatacc

SEQ ID NO: 2051 - DNA, 12 bp, synthetic construct
  misc_feature 1..12: note = Description of Artificial Sequence: Synthetic oligonucleotide
  source 1..12: mol_type = other DNA
agattcgctcga

SEQ ID NO: 2052 - DNA, 12 bp, synthetic construct
  misc_feature 1..12: note = Description of Artificial Sequence: Synthetic oligonucleotide
  source 1..12: mol_type = other DNA
tctatgcgaacg

SEQ ID NO: 2053 - DNA, 12 bp, synthetic construct
  misc_feature 1..12: note = Description of Artificial Sequence: Synthetic oligonucleotide
  source 1..12: mol_type = other DNA
atttaggacgac

SEQ ID NO: 2054 - DNA, 12 bp, synthetic construct
  misc_feature 1..12: note = Description of Artificial Sequence: Synthetic oligonucleotide
  source 1..12: mol_type = other DNA
gctgtcgtcaac

SEQ ID NO: 2055 - DNA, 12 bp, synthetic construct
  misc_feature 1..12: note = Description of Artificial Sequence: Synthetic oligonucleotide
  source 1..12: mol_type = other DNA
acccggatttcg

SEQ ID NO: 2056 - DNA, 12 bp, synthetic construct
  misc_feature 1..12: note = Description of Artificial Sequence: Synthetic oligonucleotide
  source 1..12: mol_type = other DNA
acaaggcaaggc

SEQ ID NO: 2057 - DNA, 12 bp, synthetic construct
  misc_feature 1..12: note = Description of Artificial Sequence: Synthetic oligonucleotide
  source 1..12: mol_type = other DNA
agccggagagta

SEQ ID NO: 2058 - DNA, 12 bp, synthetic construct
  misc_feature 1..12: note = Description of Artificial Sequence: Synthetic oligonucleotide
  source 1..12: mol_type = other DNA
ctatgagtccag

SEQ ID NO: 2059 - DNA, 12 bp, synthetic construct
  misc_feature 1..12: note = Description of Artificial Sequence: Synthetic oligonucleotide
  source 1..12: mol_type = other DNA
ggatagccaagg

SEQ ID NO: 2060 - DNA, 12 bp, synthetic construct
  misc_feature 1..12: note = Description of Artificial Sequence: Synthetic oligonucleotide
  source 1..12: mol_type = other DNA
atagaggccatt

SEQ ID NO: 2061 - DNA, 12 bp, synthetic construct
  misc_feature 1..12: note = Description of Artificial Sequence: Synthetic oligonucleotide
  source 1..12: mol_type = other DNA
cgtccgtatgaa

SEQ ID NO: 2062 - DNA, 12 bp, synthetic construct
  misc_feature 1..12: note = Description of Artificial Sequence: Synthetic oligonucleotide
  source 1..12: mol_type = other DNA
cgttagtgactg

SEQ ID NO: 2063 - DNA, 12 bp, synthetic construct
  misc_feature 1..12: note = Description of Artificial Sequence: Synthetic oligonucleotide
  source 1..12: mol_type = other DNA
cctgtaggttgc

SEQ ID NO: 2064 - DNA, 12 bp, synthetic construct
  misc_feature 1..12: note = Description of Artificial Sequence: Synthetic oligonucleotide
  source 1..12: mol_type = other DNA
agtcctttatcc

SEQ ID NO: 2065 - DNA, 12 bp, synthetic construct
  misc_feature 1..12: note = Description of Artificial Sequence: Synthetic oligonucleotide
  source 1..12: mol_type = other DNA
tggttggttacg

SEQ ID NO: 2066 - DNA, 12 bp, synthetic construct
  misc_feature 1..12: note = Description of Artificial Sequence: Synthetic oligonucleotide
  source 1..12: mol_type = other DNA
aagcttgaaacc

SEQ ID NO: 2067 - DNA, 12 bp, synthetic construct
  misc_feature 1..12: note = Description of Artificial Sequence: Synthetic oligonucleotide
  source 1..12: mol_type = other DNA
cgattaggaatc

SEQ ID NO: 2068 - DNA, 12 bp, synthetic construct
  misc_feature 1..12: note = Description of Artificial Sequence: Synthetic oligonucleotide
  source 1..12: mol_type = other DNA
gccgttgatgct

SEQ ID NO: 2069 - DNA, 12 bp, synthetic construct
  misc_feature 1..12: note = Description of Artificial Sequence: Synthetic oligonucleotide
  source 1..12: mol_type = other DNA
aaggcctttacg

SEQ ID NO: 2070 - DNA, 12 bp, synthetic construct
  misc_feature 1..12: note = Description of Artificial Sequence: Synthetic oligonucleotide
  source 1..12: mol_type = other DNA
agtttgcgagat

SEQ ID NO: 2071 - DNA, 12 bp, synthetic construct
  misc_feature 1..12: note = Description of Artificial Sequence: Synthetic oligonucleotide
  source 1..12: mol_type = other DNA
gtcgtccaaatg

SEQ ID NO: 2072 - DNA, 12 bp, synthetic construct
  misc_feature 1..12: note = Description of Artificial Sequence: Synthetic oligonucleotide
  source 1..12: mol_type = other DNA
taagcgtctcga

SEQ ID NO: 2073 - DNA, 12 bp, synthetic construct
  misc_feature 1..12: note = Description of Artificial Sequence: Synthetic oligonucleotide
  source 1..12: mol_type = other DNA
acgtctcagtgc

SEQ ID NO: 2074 - DNA, 12 bp, synthetic construct
  misc_feature 1..12: note = Description of Artificial Sequence: Synthetic oligonucleotide
  source 1..12: mol_type = other DNA
ttcaacctttcg

SEQ ID NO: 2075 - DNA, 12 bp, synthetic construct
  misc_feature 1..12: note = Description of Artificial Sequence: Synthetic oligonucleotide
  source 1..12: mol_type = other DNA
ctaggcaatcaa

SEQ ID NO: 2076 - DNA, 12 bp, synthetic construct
  misc_feature 1..12: note = Description of Artificial Sequence: Synthetic oligonucleotide
  source 1..12: mol_type = other DNA
tcaacgtgctgc

SEQ ID NO: 2077 - DNA, 12 bp, synthetic construct
  misc_feature 1..12: note = Description of Artificial Sequence: Synthetic oligonucleotide
  source 1..12: mol_type = other DNA
caacgtgctcca

SEQ ID NO: 2078 - DNA, 12 bp, synthetic construct
  misc_feature 1..12: note = Description of Artificial Sequence: Synthetic oligonucleotide
  source 1..12: mol_type = other DNA
atagcttcgtgg

SEQ ID NO: 2079 - DNA, 12 bp, synthetic construct
  misc_feature 1..12: note = Description of Artificial Sequence: Synthetic oligonucleotide
  source 1..12: mol_type = other DNA
tagtagcacctg

SEQ ID NO: 2080 - DNA, 12 bp, synthetic construct
  misc_feature 1..12: note = Description of Artificial Sequence: Synthetic oligonucleotide
  source 1..12: mol_type = other DNA
tgggaggtggta

SEQ ID NO: 2081 - DNA, 12 bp, synthetic construct
  misc_feature 1..12: note = Description of Artificial Sequence: Synthetic oligonucleotide
  source 1..12: mol_type = other DNA
aggacctcgttc

SEQ ID NO: 2082 - DNA, 12 bp, synthetic construct
  misc_feature 1..12: note = Description of Artificial Sequence: Synthetic oligonucleotide
  source 1..12: mol_type = other DNA
gaaccagtactc

SEQ ID NO: 2083 - DNA, 12 bp, synthetic construct
  misc_feature 1..12: note = Description of Artificial Sequence: Synthetic oligonucleotide
  source 1..12: mol_type = other DNA
tacacaagtcgc

SEQ ID NO: 2084 - DNA, 12 bp, synthetic construct
  misc_feature 1..12: note = Description of Artificial Sequence: Synthetic oligonucleotide
  source 1..12: mol_type = other DNA
cgggatcaaatt

SEQ ID NO: 2085 - DNA, 12 bp, synthetic construct
  misc_feature 1..12: note = Description of Artificial Sequence: Synthetic oligonucleotide
  source 1..12: mol_type = other DNA
aggtcatcttgg

SEQ ID NO: 2086 - DNA, 12 bp, synthetic construct
  misc_feature 1..12: note = Description of Artificial Sequence: Synthetic oligonucleotide
  source 1..12: mol_type = other DNA
cgcctgccaata

SEQ ID NO: 2087 - DNA, 12 bp, synthetic construct
  misc_feature 1..12: note = Description of Artificial Sequence: Synthetic oligonucleotide
  source 1..12: mol_type = other DNA
cttgtctggagc

SEQ ID NO: 2088 - DNA, 12 bp, synthetic construct
  misc_feature 1..12: note = Description of Artificial Sequence: Synthetic oligonucleotide
  source 1..12: mol_type = other DNA
tgataatgcacg

SEQ ID NO: 2089 - DNA, 12 bp, synthetic construct
  misc_feature 1..12: note = Description of Artificial Sequence: Synthetic oligonucleotide
  source 1..12: mol_type = other DNA
gcgtccatgaat

SEQ ID NO: 2090 - DNA, 12 bp, synthetic construct
  misc_feature 1..12: note = Description of Artificial Sequence: Synthetic oligonucleotide
  source 1..12: mol_type = other DNA
agtcatcgaatg

SEQ ID NO: 2091 - DNA, 12 bp, synthetic construct
  misc_feature 1..12: note = Description of Artificial Sequence: Synthetic oligonucleotide
  source 1..12: mol_type = other DNA
tgctgtgaccac

SEQ ID NO: 2092 - DNA, 12 bp, synthetic construct
  misc_feature 1..12: note = Description of Artificial Sequence: Synthetic oligonucleotide
  source 1..12: mol_type = other DNA
ttgagcttgagc

SEQ ID NO: 2093 - DNA, 12 bp, synthetic construct
  misc_feature 1..12: note = Description of Artificial Sequence: Synthetic oligonucleotide
  source 1..12: mol_type = other DNA
accgcatcaatg

SEQ ID NO: 2094 - DNA, 12 bp, synthetic construct
  misc_feature 1..12: note = Description of Artificial Sequence: Synthetic oligonucleotide
  source 1..12: mol_type = other DNA
tagtgatgacca

SEQ ID NO: 2095 - DNA, 12 bp, synthetic construct
  misc_feature 1..12: note = Description of Artificial Sequence: Synthetic oligonucleotide
  source 1..12: mol_type = other DNA
gtaatgcgtaac

SEQ ID NO: 2096 - DNA, 12 bp, synthetic construct
  misc_feature 1..12: note = Description of Artificial Sequence: Synthetic oligonucleotide
  source 1..12: mol_type = other DNA
atcttggagtcg

SEQ ID NO: 2097 - DNA, 12 bp, synthetic construct
  misc_feature 1..12: note = Description of Artificial Sequence: Synthetic oligonucleotide
  source 1..12: mol_type = other DNA
acacttcggcaa

SEQ ID NO: 2098 - DNA, 12 bp, synthetic construct
  misc_feature 1..12: note = Description of Artificial Sequence: Synthetic oligonucleotide
  source 1..12: mol_type = other DNA
tactaacgcggt

SEQ ID NO: 2099 - DNA, 12 bp, synthetic construct
  misc_feature 1..12: note = Description of Artificial Sequence: Synthetic oligonucleotide
  source 1..12: mol_type = other DNA
aaggtcaatcgt

SEQ ID NO: 2100 - DNA, 12 bp, synthetic construct
  misc_feature 1..12: note = Description of Artificial Sequence: Synthetic oligonucleotide
  source 1..12: mol_type = other DNA
acagccacccat

SEQ ID NO: 2101 - DNA, 12 bp, synthetic construct
  misc_feature 1..12: note = Description of Artificial Sequence: Synthetic oligonucleotide
  source 1..12: mol_type = other DNA
gtcgccgtacat

SEQ ID NO: 2102 - DNA, 12 bp, synthetic construct
  misc_feature 1..12: note = Description of Artificial Sequence: Synthetic oligonucleotide
  source 1..12: mol_type = other DNA
agcaccggtctt

SEQ ID NO: 2103 - DNA, 12 bp, synthetic construct
  misc_feature 1..12: note = Description of Artificial Sequence: Synthetic oligonucleotide
  source 1..12: mol_type = other DNA
acctcccggata

SEQ ID NO: 2104 - DNA, 12 bp, synthetic construct
  misc_feature 1..12: note = Description of Artificial Sequence: Synthetic oligonucleotide
  source 1..12: mol_type = other DNA
atccgcagtcac

SEQ ID NO: 2105 - DNA, 12 bp, synthetic construct
  misc_feature 1..12: note = Description of Artificial Sequence: Synthetic oligonucleotide
  source 1..12: mol_type = other DNA
acctacttgtct

SEQ ID NO: 2106 - DNA, 12 bp, synthetic construct
  misc_feature 1..12: note = Description of Artificial Sequence: Synthetic oligonucleotide
  source 1..12: mol_type = other DNA
tatgttgacggc

SEQ ID NO: 2107 - DNA, 12 bp, synthetic construct
  misc_feature 1..12: note = Description of Artificial Sequence: Synthetic oligonucleotide
  source 1..12: mol_type = other DNA
ggaatccgatta

SEQ ID NO: 2108 - DNA, 12 bp, synthetic construct
  misc_feature 1..12: note = Description of Artificial Sequence: Synthetic oligonucleotide
  source 1..12: mol_type = other DNA
gcaaatcagcct

SEQ ID NO: 2109 - DNA, 12 bp, synthetic construct
  misc_feature 1..12: note = Description of Artificial Sequence: Synthetic oligonucleotide
  source 1..12: mol_type = other DNA
gaagagggttga

SEQ ID NO: 2110 - DNA, 12 bp, synthetic construct
  misc_feature 1..12: note = Description of Artificial Sequence: Synthetic oligonucleotide
  source 1..12: mol_type = other DNA
agtgtaccatga

SEQ ID NO: 2111 - DNA, 12 bp, synthetic construct
  misc_feature 1..12: note = Description of Artificial Sequence: Synthetic oligonucleotide
  source 1..12: mol_type = other DNA
tgttggatcgtg

SEQ ID NO: 2112 - DNA, 12 bp, synthetic construct
  misc_feature 1..12: note = Description of Artificial Sequence: Synthetic oligonucleotide
  source 1..12: mol_type = other DNA
cgagtatacaac

SEQ ID NO: 2113 - DNA, 12 bp, synthetic construct
  misc_feature 1..12: note = Description of Artificial Sequence: Synthetic oligonucleotide
  source 1..12: mol_type = other DNA
cacccgatggtt

SEQ ID NO: 2114 - DNA, 12 bp, synthetic construct
  misc_feature 1..12: note = Description of Artificial Sequence: Synthetic oligonucleotide
  source 1..12: mol_type = other DNA
gcaagctgtctc

SEQ ID NO: 2115 - DNA, 12 bp, synthetic construct
  misc_feature 1..12: note = Description of Artificial Sequence: Synthetic oligonucleotide
  source 1..12: mol_type = other DNA
agtagacttacg

SEQ ID NO: 2116 - DNA, 12 bp, synthetic construct
  misc_feature 1..12: note = Description of Artificial Sequence: Synthetic oligonucleotide
  source 1..12: mol_type = other DNA
ccgattgaatcg

SEQ ID NO: 2117 - DNA, 12 bp, synthetic construct
  misc_feature 1..12: note = Description of Artificial Sequence: Synthetic oligonucleotide
  source 1..12: mol_type = other DNA
actggatctcgc

SEQ ID NO: 2118 - DNA, 12 bp, synthetic construct
  misc_feature 1..12: note = Description of Artificial Sequence: Synthetic oligonucleotide
  source 1..12: mol_type = other DNA
tacaccttacct

SEQ ID NO: 2119 - DNA, 12 bp, synthetic construct
  misc_feature 1..12: note = Description of Artificial Sequence: Synthetic oligonucleotide
  source 1..12: mol_type = other DNA
ttctgagaggta

SEQ ID NO: 2120 - DNA, 12 bp, synthetic construct
  misc_feature 1..12: note = Description of Artificial Sequence: Synthetic oligonucleotide
  source 1..12: mol_type = other DNA
agcggcctatta

SEQ ID NO: 2121 - DNA, 12 bp, synthetic construct
  misc_feature 1..12: note = Description of Artificial Sequence: Synthetic oligonucleotide
  source 1..12: mol_type = other DNA
tggaaaccattg

SEQ ID NO: 2122 - DNA, 12 bp, synthetic construct
  misc_feature 1..12: note = Description of Artificial Sequence: Synthetic oligonucleotide
  source 1..12: mol_type = other DNA
tatatgtgcgag

SEQ ID NO: 2123 - DNA, 12 bp, synthetic construct
  misc_feature 1..12: note = Description of Artificial Sequence: Synthetic oligonucleotide
  source 1..12: mol_type = other DNA
tcaagggacctt

SEQ ID NO: 2124 - DNA, 12 bp, synthetic construct
  misc_feature 1..12: note = Description of Artificial Sequence: Synthetic oligonucleotide
  source 1..12: mol_type = other DNA
cgttcaagctag

SEQ ID NO: 2125 - DNA, 12 bp, synthetic construct
  misc_feature 1..12: note = Description of Artificial Sequence: Synthetic oligonucleotide
  source 1..12: mol_type = other DNA
atccctacggaa

SEQ ID NO: 2126 - DNA, 12 bp, synthetic construct
  misc_feature 1..12: note = Description of Artificial Sequence: Synthetic oligonucleotide
  source 1..12: mol_type = other DNA
tcttcaactacc

SEQ ID NO: 2127 - DNA, 12 bp, synthetic construct
  misc_feature 1..12: note = Description of Artificial Sequence: Synthetic oligonucleotide
  source 1..12: mol_type = other DNA
agtccgagttgt

SEQ ID NO: 2128 - DNA, 12 bp, synthetic construct
  misc_feature 1..12: note = Description of Artificial Sequence: Synthetic oligonucleotide
  source 1..12: mol_type = other DNA
cacccacgttga

SEQ ID NO: 2129 - DNA, 12 bp, synthetic construct
  misc_feature 1..12: note = Description of Artificial Sequence: Synthetic oligonucleotide
  source 1..12: mol_type = other DNA
aagtcgacacat

SEQ ID NO: 2130 - DNA, 12 bp, synthetic construct
  misc_feature 1..12: note = Description of Artificial Sequence: Synthetic oligonucleotide
  source 1..12: mol_type = other DNA
aactcgcgctac

SEQ ID NO: 2131 - DNA, 12 bp, synthetic construct
  misc_feature 1..12: note = Description of Artificial Sequence: Synthetic oligonucleotide
  source 1..12: mol_type = other DNA
ggttccattagg

SEQ ID NO: 2132 - DNA, 12 bp, synthetic construct
  misc_feature 1..12: note = Description of Artificial Sequence: Synthetic oligonucleotide
  source 1..12: mol_type = other DNA
tggaattcggct

SEQ ID NO: 2133 - DNA, 12 bp, synthetic construct
  misc_feature 1..12: note = Description of Artificial Sequence: Synthetic oligonucleotide
  source 1..12: mol_type = other DNA
ccgcgatttcga

SEQ ID NO: 2134 - DNA, 12 bp, synthetic construct
  misc_feature 1..12: note = Description of Artificial Sequence: Synthetic oligonucleotide
  source 1..12: mol_type = other DNA
tagtgggtcaat

SEQ ID NO: 2135 - DNA, 12 bp, synthetic construct
  misc_feature 1..12: note = Description of Artificial Sequence: Synthetic oligonucleotide
  source 1..12: mol_type = other DNA
aacattgcaggt

SEQ ID NO: 2136 - DNA, 12 bp, synthetic construct
  misc_feature 1..12: note = Description of Artificial Sequence: Synthetic oligonucleotide
  source 1..12: mol_type = other DNA
taccaggattgc

SEQ ID NO: 2137 - DNA, 12 bp, synthetic construct
  misc_feature 1..12: note = Description of Artificial Sequence: Synthetic oligonucleotide
  source 1..12: mol_type = other DNA
gtgttcccagaa

SEQ ID NO: 2138 - DNA, 12 bp, synthetic construct
  misc_feature 1..12: note = Description of Artificial Sequence: Synthetic oligonucleotide
  source 1..12: mol_type = other DNA
taagatgcagtc

SEQ ID NO: 2139 - DNA, 12 bp, synthetic construct
  misc_feature 1..12: note = Description of Artificial Sequence: Synthetic oligonucleotide
  source 1..12: mol_type = other DNA
acacaccctgac

SEQ ID NO: 2140 - DNA, 12 bp, synthetic construct
  misc_feature 1..12: note = Description of Artificial Sequence: Synthetic oligonucleotide
  source 1..12: mol_type = other DNA
cctaaactacgg

SEQ ID NO: 2141 - DNA, 12 bp, synthetic construct
  misc_feature 1..12: note = Description of Artificial Sequence: Synthetic oligonucleotide
  source 1..12: mol_type = other DNA
ccatgaagtgta

SEQ ID NO: 2142 - DNA, 12 bp, synthetic construct
  misc_feature 1..12: note = Description of Artificial Sequence: Synthetic oligonucleotide
  source 1..12: mol_type = other DNA
ggttgtaagtgt

SEQ ID NO: 2143 - DNA, 12 bp, synthetic construct
  misc_feature 1..12: note = Description of Artificial Sequence: Synthetic oligonucleotide
  source 1..12: mol_type = other DNA
ccgaggtataat

SEQ ID NO: 2144 - DNA, 12 bp, synthetic construct
  misc_feature 1..12: note = Description of Artificial Sequence: Synthetic oligonucleotide
  source 1..12: mol_type = other DNA
tgccgagtaatc

SEQ ID NO: 2145 - DNA, 12 bp, synthetic construct
  misc_feature 1..12: note = Description of Artificial Sequence: Synthetic oligonucleotide
  source 1..12: mol_type = other DNA
tcacgagtcaca

SEQ ID NO: 2146 - DNA, 12 bp, synthetic construct
  misc_feature 1..12: note = Description of Artificial Sequence: Synthetic oligonucleotide
  source 1..12: mol_type = other DNA
actcccgtgtga

SEQ ID NO: 2147 - DNA, 12 bp, synthetic construct
  misc_feature 1..12: note = Description of Artificial Sequence: Synthetic oligonucleotide
  source 1..12: mol_type = other DNA
tccacagggttc

SEQ ID NO: 2148 - DNA, 12 bp, synthetic construct
  misc_feature 1..12: note = Description of Artificial Sequence: Synthetic oligonucleotide
  source 1..12: mol_type = other DNA
caacgaaccatc

SEQ ID NO: 2149 - DNA, 12 bp, synthetic construct
  misc_feature 1..12: note = Description of Artificial Sequence: Synthetic oligonucleotide
  source 1..12: mol_type = other DNA
agcgtaattagc

SEQ ID NO: 2150 - DNA, 12 bp, synthetic construct
  misc_feature 1..12: note = Description of Artificial Sequence: Synthetic oligonucleotide
  source 1..12: mol_type = other DNA
accttgacaaga

SEQ ID NO: 2151 - DNA, 12 bp, synthetic construct
  misc_feature 1..12: note = Description of Artificial Sequence: Synthetic oligonucleotide
  source 1..12: mol_type = other DNA
cacaaagcgatt

SEQ ID NO: 2152 - DNA, 12 bp, synthetic construct
  misc_feature 1..12: note = Description of Artificial Sequence: Synthetic oligonucleotide
  source 1..12: mol_type = other DNA
ctgcaagcctgt

SEQ ID NO: 2153 - DNA, 12 bp, synthetic construct
  misc_feature 1..12: note = Description of Artificial Sequence: Synthetic oligonucleotide
  source 1..12: mol_type = other DNA
tcattagcgtgg

SEQ ID NO: 2154 - DNA, 12 bp, synthetic construct
  misc_feature 1..12: note = Description of Artificial Sequence: Synthetic oligonucleotide
  source 1..12: mol_type = other DNA
ccatgcttagag

SEQ ID NO: 2155 - DNA, 12 bp, synthetic construct
  misc_feature 1..12: note = Description of Artificial Sequence: Synthetic oligonucleotide
  source 1..12: mol_type = other DNA
ctcgtgaatgac

SEQ ID NO: 2156 - DNA, 12 bp, synthetic construct
  misc_feature 1..12: note = Description of Artificial Sequence: Synthetic oligonucleotide
  source 1..12: mol_type = other DNA
gtaaccaccacc

SEQ ID NO: 2157 - DNA, 12 bp, synthetic construct
  misc_feature 1..12: note = Description of Artificial Sequence: Synthetic oligonucleotide
  source 1..12: mol_type = other DNA
caccgtgacact

SEQ ID NO: 2158 - DNA, 12 bp, synthetic construct
  misc_feature 1..12: note = Description of Artificial Sequence: Synthetic oligonucleotide
  source 1..12: mol_type = other DNA
ccaacagccaat

SEQ ID NO: 2159 - DNA, 12 bp, synthetic construct
  misc_feature 1..12: note = Description of Artificial Sequence: Synthetic oligonucleotide
  source 1..12: mol_type = other DNA
atgtcgaatagc

SEQ ID NO: 2160 - DNA, 12 bp, synthetic construct
  misc_feature 1..12: note = Description of Artificial Sequence: Synthetic oligonucleotide
  source 1..12: mol_type = other DNA
aatggcgactat

SEQ ID NO: 2161 - DNA, 12 bp, synthetic construct
  misc_feature 1..12: note = Description of Artificial Sequence: Synthetic oligonucleotide
  source 1..12: mol_type = other DNA
aggtgagttcta

SEQ ID NO: 2162 - DNA, 12 bp, synthetic construct
  misc_feature 1..12: note = Description of Artificial Sequence: Synthetic oligonucleotide
  source 1..12: mol_type = other DNA
catagctcggtc

SEQ ID NO: 2163 - DNA, 12 bp, synthetic construct
  misc_feature 1..12: note = Description of Artificial Sequence: Synthetic oligonucleotide
  source 1..12: mol_type = other DNA
gaagatctatcg

SEQ ID NO: 2164 - DNA, 12 bp, synthetic construct
  misc_feature 1..12: note = Description of Artificial Sequence: Synthetic oligonucleotide
  source 1..12: mol_type = other DNA
cggttcacatag

SEQ ID NO: 2165 - DNA, 12 bp, synthetic construct
  misc_feature 1..12: note = Description of Artificial Sequence: Synthetic oligonucleotide
  source 1..12: mol_type = other DNA
ctgaccgttaag

SEQ ID NO: 2166 - DNA, 12 bp, synthetic construct
  misc_feature 1..12: note = Description of Artificial Sequence: Synthetic oligonucleotide
  source 1..12: mol_type = other DNA
gacaggttgtat

SEQ ID NO: 2167 - DNA, 12 bp, synthetic construct
  misc_feature 1..12: note = Description of Artificial Sequence: Synthetic oligonucleotide
  source 1..12: mol_type = other DNA
cctgtcctatct

SEQ ID NO: 2168 - DNA, 12 bp, synthetic construct
  misc_feature 1..12: note = Description of Artificial Sequence: Synthetic oligonucleotide
  source 1..12: mol_type = other DNA
aaccatgccaac

SEQ ID NO: 2169 - DNA, 12 bp, synthetic construct
  misc_feature 1..12: note = Description of Artificial Sequence: Synthetic oligonucleotide
  source 1..12: mol_type = other DNA
gacggaacagac

SEQ ID NO: 2170 - DNA, 12 bp, synthetic construct
  misc_feature 1..12: note = Description of Artificial Sequence: Synthetic oligonucleotide
  source 1..12: mol_type = other DNA
tcaacagtagtg

SEQ ID NO: 2171 - DNA, 12 bp, synthetic construct
  misc_feature 1..12: note = Description of Artificial Sequence: Synthetic oligonucleotide
  source 1..12: mol_type = other DNA
tcgggctcttag

SEQ ID NO: 2172 - DNA, 12 bp, synthetic construct
  misc_feature 1..12: note = Description of Artificial Sequence: Synthetic oligonucleotide
  source 1..12: mol_type = other DNA
gactataatggc

SEQ ID NO: 2173 - DNA, 12 bp, synthetic construct
  misc_feature 1..12: note = Description of Artificial Sequence: Synthetic oligonucleotide
  source 1..12: mol_type = other DNA
ggtttaacacgc

SEQ ID NO: 2174 - DNA, 12 bp, synthetic construct
  misc_feature 1..12: note = Description of Artificial Sequence: Synthetic oligonucleotide
  source 1..12: mol_type = other DNA
tatggagctagt

SEQ ID NO: 2175 - DNA, 12 bp, synthetic construct
  misc_feature 1..12: note = Description of Artificial Sequence: Synthetic oligonucleotide
  source 1..12: mol_type = other DNA
ggaccgctttca

SEQ ID NO: 2176 - DNA, 12 bp, synthetic construct
  misc_feature 1..12: note = Description of Artificial Sequence: Synthetic oligonucleotide
  source 1..12: mol_type = other DNA
aacacatgggtt

SEQ ID NO: 2177 - DNA, 12 bp, synthetic construct
  misc_feature 1..12: note = Description of Artificial Sequence: Synthetic oligonucleotide
  source 1..12: mol_type = other DNA
actttaagggtg

SEQ ID NO: 2178 - DNA, 12 bp, synthetic construct
  misc_feature 1..12: note = Description of Artificial Sequence: Synthetic oligonucleotide
  source 1..12: mol_type = other DNA
ttcaggaactag

SEQ ID NO: 2179 - DNA, 12 bp, synthetic construct
  misc_feature 1..12: note = Description of Artificial Sequence: Synthetic oligonucleotide
  source 1..12: mol_type = other DNA
agacagtaggag

SEQ ID NO: 2180 - DNA, 12 bp, synthetic construct
  misc_feature 1..12: note = Description of Artificial Sequence: Synthetic oligonucleotide
  source 1..12: mol_type = other DNA
actacctcttca

SEQ ID NO: 2181 - DNA, 12 bp, synthetic construct
  misc_feature 1..12: note = Description of Artificial Sequence: Synthetic oligonucleotide
  source 1..12: mol_type = other DNA
cacggtcctatg

SEQ ID NO: 2182 - DNA, 12 bp, synthetic construct
  misc_feature 1..12: note = Description of Artificial Sequence: Synthetic oligonucleotide
  source 1..12: mol_type = other DNA
atcgtagtggtc

SEQ ID NO: 2183 - DNA, 12 bp, synthetic construct
  misc_feature 1..12: note = Description of Artificial Sequence: Synthetic oligonucleotide
  source 1..12: mol_type = other DNA
tggaccactagt

SEQ ID NO: 2184 - DNA, 12 bp, synthetic construct
  misc_feature 1..12: note = Description of Artificial Sequence: Synthetic oligonucleotide
  source 1..12: mol_type = other DNA
caacaggtaact

SEQ ID NO: 2185 - DNA, 12 bp, synthetic construct
  misc_feature 1..12: note = Description of Artificial Sequence: Synthetic oligonucleotide
  source 1..12: mol_type = other DNA
gccacgacttac

SEQ ID NO: 2186 - DNA, 12 bp, synthetic construct
  misc_feature 1..12: note = Description of Artificial Sequence: Synthetic oligonucleotide
  source 1..12: mol_type = other DNA
gatgataaccca

SEQ ID NO: 2187 - DNA, 12 bp, synthetic construct
  misc_feature 1..12: note = Description of Artificial Sequence: Synthetic oligonucleotide
  source 1..12: mol_type = other DNA
gaatgacgtttg

SEQ ID NO: 2188 - DNA, 12 bp, synthetic construct
  misc_feature 1..12: note = Description of Artificial Sequence: Synthetic oligonucleotide
  source 1..12: mol_type = other DNA
cgagtcacgatt

SEQ ID NO: 2189 - DNA, 12 bp, synthetic construct
  misc_feature 1..12: note = Description of Artificial Sequence: Synthetic oligonucleotide
  source 1..12: mol_type = other DNA
aaccagcagatt

SEQ ID NO: 2190 - DNA, 12 bp, synthetic construct
  misc_feature 1..12: note = Description of Artificial Sequence: Synthetic oligonucleotide
  source 1..12: mol_type = other DNA
tagttgagctga

SEQ ID NO: 2191 - DNA, 12 bp, synthetic construct
  misc_feature 1..12: note = Description of Artificial Sequence: Synthetic oligonucleotide
  source 1..12: mol_type = other DNA
attgttcctacc

SEQ ID NO: 2192 - DNA, 12 bp, synthetic construct
  misc_feature 1..12: note = Description of Artificial Sequence: Synthetic oligonucleotide
  source 1..12: mol_type = other DNA
ggcccaatataa

SEQ ID NO: 2193 - DNA, 12 bp, synthetic construct
  misc_feature 1..12: note = Description of Artificial Sequence: Synthetic oligonucleotide
  source 1..12: mol_type = other DNA
acttacgccacg

SEQ ID NO: 2194 - DNA, 12 bp, synthetic construct
  misc_feature 1..12: note = Description of Artificial Sequence: Synthetic oligonucleotide
  source 1..12: mol_type = other DNA
agtgcgttctag

SEQ ID NO: 2195 - DNA, 12 bp, synthetic construct
  misc_feature 1..12: note = Description of Artificial Sequence: Synthetic oligonucleotide
  source 1..12: mol_type = other DNA
atcgaggatcta

SEQ ID NO: 2196 - DNA, 12 bp, synthetic construct
  misc_feature 1..12: note = Description of Artificial Sequence: Synthetic oligonucleotide
  source 1..12: mol_type = other DNA
gtctcaaagcac

SEQ ID NO: 2197 - DNA, 12 bp, synthetic construct
  misc_feature 1..12: note = Description of Artificial Sequence: Synthetic oligonucleotide
  source 1..12: mol_type = other DNA
gccgtaaacttg

SEQ ID NO: 2198 - DNA, 12 bp, synthetic construct
  misc_feature 1..12: note = Description of Artificial Sequence: Synthetic oligonucleotide
  source 1..12: mol_type = other DNA
ttgtatgacagg

SEQ ID NO: 2199 - DNA, 12 bp, synthetic construct
  misc_feature 1..12: note = Description of Artificial Sequence: Synthetic oligonucleotide
  source 1..12: mol_type = other DNA
acgcctttctta

SEQ ID NO: 2200 - DNA, 12 bp, synthetic construct
  misc_feature 1..12: note = Description of Artificial Sequence: Synthetic oligonucleotide
  source 1..12: mol_type = other DNA
ttcttaacgcct

SEQ ID NO: 2201 - DNA, 12 bp, synthetic construct
  misc_feature 1..12: note = Description of Artificial Sequence: Synthetic oligonucleotide
  source 1..12: mol_type = other DNA
tagctggcgttc

SEQ ID NO: 2202 - DNA, 12 bp, synthetic construct
  misc_feature 1..12: note = Description of Artificial Sequence: Synthetic oligonucleotide
  source 1..12: mol_type = other DNA
agttgcctgaac

SEQ ID NO: 2203 - DNA, 12 bp, synthetic construct
  misc_feature 1..12: note = Description of Artificial Sequence: Synthetic oligonucleotide
  source 1..12: mol_type = other DNA
gcagatttccag

SEQ ID NO: 2204 - DNA, 12 bp, synthetic construct
  misc_feature 1..12: note = Description of Artificial Sequence: Synthetic oligonucleotide
  source 1..12: mol_type = other DNA
ggtaagtttgac

SEQ ID NO: 2205 - DNA, 12 bp, synthetic construct
  misc_feature 1..12: note = Description of Artificial Sequence: Synthetic oligonucleotide
  source 1..12: mol_type = other DNA
ttggtgcctgtg

SEQ ID NO: 2206 - DNA, 12 bp, synthetic construct
  misc_feature 1..12: note = Description of Artificial Sequence: Synthetic oligonucleotide
  source 1..12: mol_type = other DNA
acccagtatggt

SEQ ID NO: 2207 - DNA, 12 bp, synthetic construct
  misc_feature 1..12: note = Description of Artificial Sequence: Synthetic oligonucleotide
  source 1..12: mol_type = other DNA
cacaagtatcga

SEQ ID NO: 2208 - DNA, 12 bp, synthetic construct
  misc_feature 1..12: note = Description of Artificial Sequence: Synthetic oligonucleotide
  source 1..12: mol_type = other DNA
tggtagtctgaa

SEQ ID NO: 2209 - DNA, 12 bp, synthetic construct
  misc_feature 1..12: note = Description of Artificial Sequence: Synthetic oligonucleotide
  source 1..12: mol_type = other DNA
agatgatcagtc

SEQ ID NO: 2210 - DNA, 12 bp, synthetic construct
  misc_feature 1..12: note = Description of Artificial Sequence: Synthetic oligonucleotide
  source 1..12: mol_type = other DNA
ctaccacggtac

SEQ ID NO: 2211 - DNA, 12 bp, synthetic construct
  misc_feature 1..12: note = Description of Artificial Sequence: Synthetic oligonucleotide
  source 1..12: mol_type = other DNA
catcggatctga

SEQ ID NO: 2212 - DNA, 12 bp, synthetic construct
  misc_feature 1..12: note = Description of Artificial Sequence: Synthetic oligonucleotide
  source 1..12: mol_type = other DNA
cgttaagtcagc

SEQ ID NO: 2213 - DNA, 12 bp, synthetic construct
  misc_feature 1..12: note = Description of Artificial Sequence: Synthetic oligonucleotide
  source 1..12: mol_type = other DNA
gattgtgcaacc

SEQ ID NO: 2214 - DNA, 12 bp, synthetic construct
  misc_feature 1..12: note = Description of Artificial Sequence: Synthetic oligonucleotide
  source 1..12: mol_type = other DNA
gcatgtcgaaat

SEQ ID NO: 2215 - DNA, 12 bp, synthetic construct
  misc_feature 1..12: note = Description of Artificial Sequence: Synthetic oligonucleotide
  source 1..12: mol_type = other DNA
gagacgtgttct

SEQ ID NO: 2216 - DNA, 12 bp, synthetic construct
  misc_feature 1..12: note = Description of Artificial Sequence: Synthetic oligonucleotide
  source 1..12: mol_type = other DNA
cggtctgtctga

SEQ ID NO: 2217 - DNA, 12 bp, synthetic construct
  misc_feature 1..12: note = Description of Artificial Sequence: Synthetic oligonucleotide
  source 1..12: mol_type = other DNA
catgtcttccat

SEQ ID NO: 2218 - DNA, 12 bp, synthetic construct
  misc_feature 1..12: note = Description of Artificial Sequence: Synthetic oligonucleotide
  source 1..12: mol_type = other DNA
tcacaacaccgc

SEQ ID NO: 2219 - DNA, 12 bp, synthetic construct
  misc_feature 1..12: note = Description of Artificial Sequence: Synthetic oligonucleotide
  source 1..12: mol_type = other DNA
ctacagggtctc

SEQ ID NO: 2220 - DNA, 12 bp, synthetic construct
  misc_feature 1..12: note = Description of Artificial Sequence: Synthetic oligonucleotide
  source 1..12: mol_type = other DNA
cctatgcacggt

SEQ ID NO: 2221 - DNA, 12 bp, synthetic construct
  misc_feature 1..12: note = Description of Artificial Sequence: Synthetic oligonucleotide
  source 1..12: mol_type = other DNA
tatcaccggcac

SEQ ID NO: 2222 - DNA, 12 bp, synthetic construct
  misc_feature 1..12: note = Description of Artificial Sequence: Synthetic oligonucleotide
  source 1..12: mol_type = other DNA
gtacatgtcgcc

SEQ ID NO: 2223 - DNA, 12 bp, synthetic construct
  misc_feature 1..12: note = Description of Artificial Sequence: Synthetic oligonucleotide
  source 1..12: mol_type = other DNA
gttacagttggc

SEQ ID NO: 2224 - DNA, 12 bp, synthetic construct
  misc_feature 1..12: note = Description of Artificial Sequence: Synthetic oligonucleotide
  source 1..12: mol_type = other DNA
agcaaggtcttc

SEQ ID NO: 2225 - DNA, 12 bp, synthetic construct
  misc_feature 1..12: note = Description of Artificial Sequence: Synthetic oligonucleotide
  source 1..12: mol_type = other DNA
gtaccaggtact

SEQ ID NO: 2226 - DNA, 12 bp, synthetic construct
  misc_feature 1..12: note = Description of Artificial Sequence: Synthetic oligonucleotide
  source 1..12: mol_type = other DNA
gcgtggtcatta

SEQ ID NO: 2227 - DNA, 12 bp, synthetic construct
  misc_feature 1..12: note = Description of Artificial Sequence: Synthetic oligonucleotide
  source 1..12: mol_type = other DNA
tatgccagagat

SEQ ID NO: 2228 - DNA, 12 bp, synthetic construct
  misc_feature 1..12: note = Description of Artificial Sequence: Synthetic oligonucleotide
  source 1..12: mol_type = other DNA
ttctagagtgcg

SEQ ID NO: 2229 - DNA, 12 bp, synthetic construct
  misc_feature 1..12: note = Description of Artificial Sequence: Synthetic oligonucleotide
  source 1..12: mol_type = other DNA
cggactcgttac

SEQ ID NO: 2230 - DNA, 12 bp, synthetic construct
  misc_feature 1..12: note = Description of Artificial Sequence: Synthetic oligonucleotide
  source 1..12: mol_type = other DNA
tctaaaccctct

SEQ ID NO: 2231 - DNA, 12 bp, synthetic construct
  misc_feature 1..12: note = Description of Artificial Sequence: Synthetic oligonucleotide
  source 1..12: mol_type = other DNA
gtatacccttct

SEQ ID NO: 2232 - DNA, 12 bp, synthetic construct
  misc_feature 1..12: note = Description of Artificial Sequence: Synthetic oligonucleotide
  source 1..12: mol_type = other DNA
agtcacatccgc

SEQ ID NO: 2233 - DNA, 12 bp, synthetic construct
  misc_feature 1..12: note = Description of Artificial Sequence: Synthetic oligonucleotide
  source 1..12: mol_type = other DNA
aggtccaaatca

SEQ ID NO: 2234 - DNA, 12 bp, synthetic construct
  misc_feature 1..12: note = Description of Artificial Sequence: Synthetic oligonucleotide
  source 1..12: mol_type = other DNA
acggatgttatg

SEQ ID NO: 2235 - DNA, 12 bp, synthetic construct
  misc_feature 1..12: note = Description of Artificial Sequence: Synthetic oligonucleotide
  source 1..12: mol_type = other DNA
tctcgcactgga

SEQ ID NO: 2236 - DNA, 12 bp, synthetic construct
  misc_feature 1..12: note = Description of Artificial Sequence: Synthetic oligonucleotide
  source 1..12: mol_type = other DNA
cctgatcacacg

SEQ ID NO: 2237 - DNA, 12 bp, synthetic construct
  misc_feature 1..12: note = Description of Artificial Sequence: Synthetic oligonucleotide
  source 1..12: mol_type = other DNA
taggtctaggtc

SEQ ID NO: 2238 - DNA, 12 bp, synthetic construct
  misc_feature 1..12: note = Description of Artificial Sequence: Synthetic oligonucleotide
  source 1..12: mol_type = other DNA
agcgtctgaact

SEQ ID NO: 2239 - DNA, 12 bp, synthetic construct
  misc_feature 1..12: note = Description of Artificial Sequence: Synthetic oligonucleotide
  source 1..12: mol_type = other DNA
accgtgctcaca

SEQ ID NO: 2240 - DNA, 12 bp, synthetic construct
  misc_feature 1..12: note = Description of Artificial Sequence: Synthetic oligonucleotide
  source 1..12: mol_type = other DNA
ttgaggctacaa

SEQ ID NO: 2241 - DNA, 12 bp, synthetic construct
  misc_feature 1..12: note = Description of Artificial Sequence: Synthetic oligonucleotide
  source 1..12: mol_type = other DNA
ttctggtcttgt

SEQ ID NO: 2242 - DNA, 12 bp, synthetic construct
  misc_feature 1..12: note = Description of Artificial Sequence: Synthetic oligonucleotide
  source 1..12: mol_type = other DNA
aagctgcctagt

SEQ ID NO: 2243 - DNA, 12 bp, synthetic construct
  misc_feature 1..12: note = Description of Artificial Sequence: Synthetic oligonucleotide
  source 1..12: mol_type = other DNA
gacagtagcttc

SEQ ID NO: 2244 - DNA, 12 bp, synthetic construct
  misc_feature 1..12: note = Description of Artificial Sequence: Synthetic oligonucleotide
  source 1..12: mol_type = other DNA
atcgcgactgct

SEQ ID NO: 2245 - DNA, 12 bp, synthetic construct
  misc_feature 1..12: note = Description of Artificial Sequence: Synthetic oligonucleotide
  source 1..12: mol_type = other DNA
ctccctttgtgt

SEQ ID NO: 2246 - DNA, 12 bp, synthetic construct
  misc_feature 1..12: note = Description of Artificial Sequence: Synthetic oligonucleotide
  source 1..12: mol_type = other DNA
gtaggaaccgga

SEQ ID NO: 2247 - DNA, 12 bp, synthetic construct
  misc_feature 1..12: note = Description of Artificial Sequence: Synthetic oligonucleotide
  source 1..12: mol_type = other DNA
gtccacttggac

SEQ ID NO: 2248 - DNA, 12 bp, synthetic construct
  misc_feature 1..12: note = Description of Artificial Sequence: Synthetic oligonucleotide
  source 1..12: mol_type = other DNA
atttgtgggtag

SEQ ID NO: 2249 - DNA, 12 bp, synthetic construct
  misc_feature 1..12: note = Description of Artificial Sequence: Synthetic oligonucleotide
  source 1..12: mol_type = other DNA
tgaacgttggat

SEQ ID NO: 2250 - DNA, 12 bp, synthetic construct
  misc_feature 1..12: note = Description of Artificial Sequence: Synthetic oligonucleotide
  source 1..12: mol_type = other DNA
tggaggttctca

SEQ ID NO: 2251 - DNA, 12 bp, synthetic construct
  misc_feature 1..12: note = Description of Artificial Sequence: Synthetic oligonucleotide
  source 1..12: mol_type = other DNA
agctgcacctaa

SEQ ID NO: 2252 - DNA, 12 bp, synthetic construct
  misc_feature 1..12: note = Description of Artificial Sequence: Synthetic oligonucleotide
  source 1..12: mol_type = other DNA
acatctagcaga

SEQ ID NO: 2253 - DNA, 12 bp, synthetic construct
  misc_feature 1..12: note = Description of Artificial Sequence: Synthetic oligonucleotide
  source 1..12: mol_type = other DNA
gatttagaggct

SEQ ID NO: 2254 - DNA, 12 bp, synthetic construct
  misc_feature 1..12: note = Description of Artificial Sequence: Synthetic oligonucleotide
  source 1..12: mol_type = other DNA
tacatggagcat

SEQ ID NO: 2255 - DNA, 12 bp, synthetic construct
  misc_feature 1..12: note = Description of Artificial Sequence: Synthetic oligonucleotide
  source 1..12: mol_type = other DNA
agtgtgaacgtt

SEQ ID NO: 2256 - DNA, 12 bp, synthetic construct
  misc_feature 1..12: note = Description of Artificial Sequence: Synthetic oligonucleotide
  source 1..12: mol_type = other DNA
tgcttgtaggca

SEQ ID NO: 2257 - DNA, 12 bp, synthetic construct
  misc_feature 1..12: note = Description of Artificial Sequence: Synthetic oligonucleotide
  source 1..12: mol_type = other DNA
ccttgaccgatg

SEQ ID NO: 2258 - DNA, 12 bp, synthetic construct
  misc_feature 1..12: note = Description of Artificial Sequence: Synthetic oligonucleotide
  source 1..12: mol_type = other DNA
ccgacattgtag

SEQ ID NO: 2259 - DNA, 12 bp, synthetic construct
  misc_feature 1..12: note = Description of Artificial Sequence: Synthetic oligonucleotide
  source 1..12: mol_type = other DNA
gtcagccgttaa

SEQ ID NO: 2260 - DNA, 12 bp, synthetic construct
  misc_feature 1..12: note = Description of Artificial Sequence: Synthetic oligonucleotide
  source 1..12: mol_type = other DNA
gcctcagcagtt

SEQ ID NO: 2261 - DNA, 12 bp, synthetic construct
  misc_feature 1..12: note = Description of Artificial Sequence: Synthetic oligonucleotide
  source 1..12: mol_type = other DNA
atggtcacaaac

SEQ ID NO: 2262 - DNA, 12 bp, synthetic construct
  misc_feature 1..12: note = Description of Artificial Sequence: Synthetic oligonucleotide
  source 1..12: mol_type = other DNA
cttaaatgggca

SEQ ID NO: 2263 - DNA, 12 bp, synthetic construct
  misc_feature 1..12: note = Description of Artificial Sequence: Synthetic oligonucleotide
  source 1..12: mol_type = other DNA
ctatcatcctca

SEQ ID NO: 2264 - DNA, 12 bp, synthetic construct
  misc_feature 1..12: note = Description of Artificial Sequence: Synthetic oligonucleotide
  source 1..12: mol_type = other DNA
catgtaaggctc

SEQ ID NO: 2265 - DNA, 12 bp, synthetic construct
  misc_feature 1..12: note = Description of Artificial Sequence: Synthetic oligonucleotide
  source 1..12: mol_type = other DNA
acggtttctgga

SEQ ID NO: 2266 - DNA, 12 bp, synthetic construct
  misc_feature 1..12: note = Description of Artificial Sequence: Synthetic oligonucleotide
  source 1..12: mol_type = other DNA
catcttctgatc

SEQ ID NO: 2267 - DNA, 12 bp, synthetic construct
  misc_feature 1..12: note = Description of Artificial Sequence: Synthetic oligonucleotide
  source 1..12: mol_type = other DNA
acatagcggttc

SEQ ID NO: 2268 - DNA, 12 bp, synthetic construct
  misc_feature 1..12: note = Description of Artificial Sequence: Synthetic oligonucleotide
  source 1..12: mol_type = other DNA
ggtatcaccctg

SEQ ID NO: 2269 - DNA, 12 bp, synthetic construct
  misc_feature 1..12: note = Description of Artificial Sequence: Synthetic oligonucleotide
  source 1..12: mol_type = other DNA
actctagccggt

SEQ ID NO: 2270 - DNA, 12 bp, synthetic construct
  misc_feature 1..12: note = Description of Artificial Sequence: Synthetic oligonucleotide
  source 1..12: mol_type = other DNA
tgcaagctaagt

SEQ ID NO: 2271 - DNA, 12 bp, synthetic construct
  misc_feature 1..12: note = Description of Artificial Sequence: Synthetic oligonucleotide
  source 1..12: mol_type = other DNA
gcagccatattg

SEQ ID NO: 2272 - DNA, 12 bp, synthetic construct
  misc_feature 1..12: note = Description of Artificial Sequence: Synthetic oligonucleotide
  source 1..12: mol_type = other DNA
caggttgtgcct

SEQ ID NO: 2273 - DNA, 12 bp, synthetic construct
  misc_feature 1..12: note = Description of Artificial Sequence: Synthetic oligonucleotide
  source 1..12: mol_type = other DNA
gctgtttgaccg

SEQ ID NO: 2274 - DNA, 12 bp, synthetic construct
  misc_feature 1..12: note = Description of Artificial Sequence: Synthetic oligonucleotide
  source 1..12: mol_type = other DNA
cgccttgataag

SEQ ID NO: 2275 - DNA, 12 bp, synthetic construct
  misc_feature 1..12: note = Description of Artificial Sequence: Synthetic oligonucleotide
  source 1..12: mol_type = other DNA
cgataggcctta

SEQ ID NO: 2276 - DNA, 12 bp, synthetic construct
  misc_feature 1..12: note = Description of Artificial Sequence: Synthetic oligonucleotide
  source 1..12: mol_type = other DNA
gtgtgtgccata

SEQ ID NO: 2277 - DNA, 12 bp, synthetic construct
  misc_feature 1..12: note = Description of Artificial Sequence: Synthetic oligonucleotide
  source 1..12: mol_type = other DNA
ataggtgtgcta

SEQ ID NO: 2278 - DNA, 12 bp, synthetic construct
  misc_feature 1..12: note = Description of Artificial Sequence: Synthetic oligonucleotide
  source 1..12: mol_type = other DNA
ggttgccctgta

SEQ ID NO: 2279 - DNA, 12 bp, synthetic construct
  misc_feature 1..12: note = Description of Artificial Sequence: Synthetic oligonucleotide
  source 1..12: mol_type = other DNA
cgaatactgaca

SEQ ID NO: 2280 - DNA, 12 bp, synthetic construct
  misc_feature 1..12: note = Description of Artificial Sequence: Synthetic oligonucleotide
  source 1..12: mol_type = other DNA
cgtttatccgtt

SEQ ID NO: 2281 - DNA, 12 bp, synthetic construct
  misc_feature 1..12: note = Description of Artificial Sequence: Synthetic oligonucleotide
  source 1..12: mol_type = other DNA
aatgacctcgtg

SEQ ID NO: 2282 - DNA, 12 bp, synthetic construct
  misc_feature 1..12: note = Description of Artificial Sequence: Synthetic oligonucleotide
  source 1..12: mol_type = other DNA
tgacaaccgaat

SEQ ID NO: 2283 - DNA, 12 bp, synthetic construct
  misc_feature 1..12: note = Description of Artificial Sequence: Synthetic oligonucleotide
  source 1..12: mol_type = other DNA
acctagctagtg

SEQ ID NO: 2284 - DNA, 12 bp, synthetic construct
  misc_feature 1..12: note = Description of Artificial Sequence: Synthetic oligonucleotide
  source 1..12: mol_type = other DNA
tggtttcgaaga

SEQ ID NO: 2285 - DNA, 12 bp, synthetic construct
  misc_feature 1..12: note = Description of Artificial Sequence: Synthetic oligonucleotide
  source 1..12: mol_type = other DNA
tatcctggtttc

SEQ ID NO: 2286 - DNA, 12 bp, synthetic construct
  misc_feature 1..12: note = Description of Artificial Sequence: Synthetic oligonucleotide
  source 1..12: mol_type = other DNA
ttgtactcactc

SEQ ID NO: 2287 - DNA, 12 bp, synthetic construct
  misc_feature 1..12: note = Description of Artificial Sequence: Synthetic oligonucleotide
  source 1..12: mol_type = other DNA
cttaggcatgtg

SEQ ID NO: 2288 - DNA, 12 bp, synthetic construct
  misc_feature 1..12: note = Description of Artificial Sequence: Synthetic oligonucleotide
  source 1..12: mol_type = other DNA
taggctcgtgct

SEQ ID NO: 2289 - DNA, 12 bp, synthetic construct
  misc_feature 1..12: note = Description of Artificial Sequence: Synthetic oligonucleotide
  source 1..12: mol_type = other DNA
gtcctgacactg

SEQ ID NO: 2290 - DNA, 12 bp, synthetic construct
  misc_feature 1..12: note = Description of Artificial Sequence: Synthetic oligonucleotide
  source 1..12: mol_type = other DNA
tgcgttctagcg

SEQ ID NO: 2291 - DNA, 12 bp, synthetic construct
  misc_feature 1..12: note = Description of Artificial Sequence: Synthetic oligonucleotide
  source 1..12: mol_type = other DNA
cattgtccctat

SEQ ID NO: 2292 - DNA, 12 bp, synthetic construct
  misc_feature 1..12: note = Description of Artificial Sequence: Synthetic oligonucleotide
  source 1..12: mol_type = other DNA
ttcccacccatt

SEQ ID NO: 2293 - DNA, 12 bp, synthetic construct
  misc_feature 1..12: note = Description of Artificial Sequence: Synthetic oligonucleotide
  source 1..12: mol_type = other DNA
ccagatatagca

SEQ ID NO: 2294 - DNA, 12 bp, synthetic construct
  misc_feature 1..12: note = Description of Artificial Sequence: Synthetic oligonucleotide
  source 1..12: mol_type = other DNA
ctccttaaggcg

SEQ ID NO: 2295 - DNA, 12 bp, synthetic construct
  misc_feature 1..12: note = Description of Artificial Sequence: Synthetic oligonucleotide
  source 1..12: mol_type = other DNA
ggactcaactaa

SEQ ID NO: 2296 - DNA, 12 bp, synthetic construct
  misc_feature 1..12: note = Description of Artificial Sequence: Synthetic oligonucleotide
  source 1..12: mol_type = other DNA
agtccactggta

SEQ ID NO: 2297 - DNA, 12 bp, synthetic construct
  misc_feature 1..12: note = Description of Artificial Sequence: Synthetic oligonucleotide
  source 1..12: mol_type = other DNA
accgacgcttgt

SEQ ID NO: 2298 - DNA, 12 bp, synthetic construct
  misc_feature 1..12: note = Description of Artificial Sequence: Synthetic oligonucleotide
  source 1..12: mol_type = other DNA
gccgcattcgat

SEQ ID NO: 2299 - DNA, 12 bp, synthetic construct
  misc_feature 1..12: note = Description of Artificial Sequence: Synthetic oligonucleotide
  source 1..12: mol_type = other DNA
gagagtccactt

SEQ ID NO: 2300 - DNA, 12 bp, synthetic construct
  misc_feature 1..12: note = Description of Artificial Sequence: Synthetic oligonucleotide
  source 1..12: mol_type = other DNA
ttgcctgggtca

SEQ ID NO: 2301 - DNA, 12 bp, synthetic construct
  misc_feature 1..12: note = Description of Artificial Sequence: Synthetic oligonucleotide
  source 1..12: mol_type = other DNA
atacgggttcgt

SEQ ID NO: 2302 - DNA, 12 bp, synthetic construct
  misc_feature 1..12: note = Description of Artificial Sequence: Synthetic oligonucleotide
  source 1..12: mol_type = other DNA
gaactcgctatg

SEQ ID NO: 2303 - DNA, 12 bp, synthetic construct
  misc_feature 1..12: note = Description of Artificial Sequence: Synthetic oligonucleotide
  source 1..12: mol_type = other DNA
ctgtgatcggat

SEQ ID NO: 2304 - DNA, 12 bp, synthetic construct
  misc_feature 1..12: note = Description of Artificial Sequence: Synthetic oligonucleotide
  source 1..12: mol_type = other DNA
gaacgggacgta

SEQ ID NO: 2305 - DNA, 12 bp, synthetic construct
  misc_feature 1..12: note = Description of Artificial Sequence: Synthetic oligonucleotide
  source 1..12: mol_type = other DNA
caattctgcttc

SEQ ID NO: 2306 - DNA, 12 bp, synthetic construct
  misc_feature 1..12: note = Description of Artificial Sequence: Synthetic oligonucleotide
  source 1..12: mol_type = other DNA
cctttcacctgt

SEQ ID NO: 2307 - DNA, 12 bp, synthetic construct
  misc_feature 1..12: note = Description of Artificial Sequence: Synthetic oligonucleotide
  source 1..12: mol_type = other DNA
ggtagttcatag

SEQ ID NO: 2308 - DNA, 12 bp, synthetic construct
  misc_feature 1..12: note = Description of Artificial Sequence: Synthetic oligonucleotide
  source 1..12: mol_type = other DNA
atgtacaccggt

SEQ ID NO: 2309 - DNA, 12 bp, synthetic construct
  misc_feature 1..12: note = Description of Artificial Sequence: Synthetic oligonucleotide
  source 1..12: mol_type = other DNA
acgtgtaggctt

SEQ ID NO: 2310 - DNA, 12 bp, synthetic construct
  misc_feature 1..12: note = Description of Artificial Sequence: Synthetic oligonucleotide
  source 1..12: mol_type = other DNA
actggcaaacct

SEQ ID NO: 2311 - DNA, 12 bp, synthetic construct
  misc_feature 1..12: note = Description of Artificial Sequence: Synthetic oligonucleotide
  source 1..12: mol_type = other DNA
atcagccagctc

SEQ ID NO: 2312 - DNA, 12 bp, synthetic construct
  misc_feature 1..12: note = Description of Artificial Sequence: Synthetic oligonucleotide
  source 1..12: mol_type = other DNA
aggatgggatgc

SEQ ID NO: 2313 - DNA, 12 bp, synthetic construct
  misc_feature 1..12: note = Description of Artificial Sequence: Synthetic oligonucleotide
  source 1..12: mol_type = other DNA
taagctaaaccg

SEQ ID NO: 2314 - DNA, 12 bp, synthetic construct
  misc_feature 1..12: note = Description of Artificial Sequence: Synthetic oligonucleotide
  source 1..12: mol_type = other DNA
ggtctcctacag

SEQ ID NO: 2315 - DNA, 12 bp, synthetic construct
  misc_feature 1..12: note = Description of Artificial Sequence: Synthetic oligonucleotide
  source 1..12: mol_type = other DNA
aatcagagcttg

SEQ ID NO: 2316 - DNA, 12 bp, synthetic construct
  misc_feature 1..12: note = Description of Artificial Sequence: Synthetic oligonucleotide
  source 1..12: mol_type = other DNA
gctccacaacgt

SEQ ID NO: 2317 - DNA, 12 bp, synthetic construct
  misc_feature 1..12: note = Description of Artificial Sequence: Synthetic oligonucleotide
  source 1..12: mol_type = other DNA
cagtgatactgc

SEQ ID NO: 2318 - DNA, 12 bp, synthetic construct
  misc_feature 1..12: note = Description of Artificial Sequence: Synthetic oligonucleotide
  source 1..12: mol_type = other DNA
cattgggagttc

SEQ ID NO: 2319 - DNA, 12 bp, synthetic construct
  misc_feature 1..12: note = Description of Artificial Sequence: Synthetic oligonucleotide
  source 1..12: mol_type = other DNA
actgacttaagg

SEQ ID NO: 2320 - DNA, 12 bp, synthetic construct
  misc_feature 1..12: note = Description of Artificial Sequence: Synthetic oligonucleotide
  source 1..12: mol_type = other DNA
caatgtagacac

SEQ ID NO: 2321 - DNA, 12 bp, synthetic construct
  misc_feature 1..12: note = Description of Artificial Sequence: Synthetic oligonucleotide
  source 1..12: mol_type = other DNA
aaggagtgcgca

SEQ ID NO: 2322 - DNA, 12 bp, synthetic construct
  misc_feature 1..12: note = Description of Artificial Sequence: Synthetic oligonucleotide
  source 1..12: mol_type = other DNA
gaggatactact

SEQ ID NO: 2323 - DNA, 12 bp, synthetic construct
  misc_feature 1..12: note = Description of Artificial Sequence: Synthetic oligonucleotide
  source 1..12: mol_type = other DNA
gatcggttaatg

SEQ ID NO: 2324 - DNA, 12 bp, synthetic construct
  misc_feature 1..12: note = Description of Artificial Sequence: Synthetic oligonucleotide
  source 1..12: mol_type = other DNA
gatgctgccgtt

SEQ ID NO: 2325 - DNA, 12 bp, synthetic construct
  misc_feature 1..12: note = Description of Artificial Sequence: Synthetic oligonucleotide
  source 1..12: mol_type = other DNA
tggcgatacgtt

SEQ ID NO: 2326 - DNA, 12 bp, synthetic construct
  misc_feature 1..12: note = Description of Artificial Sequence: Synthetic oligonucleotide
  source 1..12: mol_type = other DNA
agggaaaggatc

SEQ ID NO: 2327 - DNA, 12 bp, synthetic construct
  misc_feature 1..12: note = Description of Artificial Sequence: Synthetic oligonucleotide
  source 1..12: mol_type = other DNA
gcatcgtctggt

SEQ ID NO: 2328 - DNA, 12 bp, synthetic construct
  misc_feature 1..12: note = Description of Artificial Sequence: Synthetic oligonucleotide
  source 1..12: mol_type = other DNA
cagcgactgtta

SEQ ID NO: 2329 - DNA, 12 bp, synthetic construct
  misc_feature 1..12: note = Description of Artificial Sequence: Synthetic oligonucleotide
  source 1..12: mol_type = other DNA
ttcctaggccag

SEQ ID NO: 2330 - DNA, 12 bp, synthetic construct
  misc_feature 1..12: note = Description of Artificial Sequence: Synthetic oligonucleotide
  source 1..12: mol_type = other DNA
gccttacgatag

SEQ ID NO: 2331 - DNA, 12 bp, synthetic construct
  misc_feature 1..12: note = Description of Artificial Sequence: Synthetic oligonucleotide
  source 1..12: mol_type = other DNA
acgacgcatttg

SEQ ID NO: 2332 - DNA, 12 bp, synthetic construct
  misc_feature 1..12: note = Description of Artificial Sequence: Synthetic oligonucleotide
  source 1..12: mol_type = other DNA
tatgggtagcta

SEQ ID NO: 2333 - DNA, 12 bp, synthetic construct
  misc_feature 1..12: note = Description of Artificial Sequence: Synthetic oligonucleotide
  source 1..12: mol_type = other DNA
gagcccaaagag

SEQ ID NO: 2334 - DNA, 12 bp, synthetic construct
  misc_feature 1..12: note = Description of Artificial Sequence: Synthetic oligonucleotide
  source 1..12: mol_type = other DNA
attaagcctgga

SEQ ID NO: 2335 - DNA, 12 bp, synthetic construct
  misc_feature 1..12: note = Description of Artificial Sequence: Synthetic oligonucleotide
  source 1..12: mol_type = other DNA
tacctgtgtctt

SEQ ID NO: 2336 - DNA, 12 bp, synthetic construct
  misc_feature 1..12: note = Description of Artificial Sequence: Synthetic oligonucleotide
  source 1..12: mol_type = other DNA
cgtcactccaag

SEQ ID NO: 2337 - DNA, 12 bp, synthetic construct
  misc_feature 1..12: note = Description of Artificial Sequence: Synthetic oligonucleotide
  source 1..12: mol_type = other DNA
aggtattaccga

SEQ ID NO: 2338 - DNA, 12 bp, synthetic construct
  misc_feature 1..12: note = Description of Artificial Sequence: Synthetic oligonucleotide
  source 1..12: mol_type = other DNA
cgatcaccacaa

SEQ ID NO: 2339 - DNA, 12 bp, synthetic construct
  misc_feature 1..12: note = Description of Artificial Sequence: Synthetic oligonucleotide
  source 1..12: mol_type = other DNA
tggctttctatc

SEQ ID NO: 2340 - DNA, 12 bp, synthetic construct
  misc_feature 1..12: note = Description of Artificial Sequence: Synthetic oligonucleotide
  source 1..12: mol_type = other DNA
aacgaggcaacg

SEQ ID NO: 2341 - DNA, 12 bp, synthetic construct
  misc_feature 1..12: note = Description of Artificial Sequence: Synthetic oligonucleotide
  source 1..12: mol_type = other DNA
ttacacaaaggc

SEQ ID NO: 2342 - DNA, 12 bp, synthetic construct
  misc_feature 1..12: note = Description of Artificial Sequence: Synthetic oligonucleotide
  source 1..12: mol_type = other DNA
tgtcaaagtgac

SEQ ID NO: 2343 - DNA, 12 bp, synthetic construct
  misc_feature 1..12: note = Description of Artificial Sequence: Synthetic oligonucleotide
  source 1..12: mol_type = other DNA
ctagagctccca

SEQ ID NO: 2344 - DNA, 12 bp, synthetic construct
  misc_feature 1..12: note = Description of Artificial Sequence: Synthetic oligonucleotide
  source 1..12: mol_type = other DNA
acagctcaaaca

SEQ ID NO: 2345 - DNA, 12 bp, synthetic construct
  misc_feature 1..12: note = Description of Artificial Sequence: Synthetic oligonucleotide
  source 1..12: mol_type = other DNA
gaagacagcgac

SEQ ID NO: 2346 - DNA, 12 bp, synthetic construct
  misc_feature 1..12: note = Description of Artificial Sequence: Synthetic oligonucleotide
  source 1..12: mol_type = other DNA
gtatagtccgtg

SEQ ID NO: 2347 - DNA, 12 bp, synthetic construct
  misc_feature 1..12: note = Description of Artificial Sequence: Synthetic oligonucleotide
  source 1..12: mol_type = other DNA
gtaacggctcta

SEQ ID NO: 2348 - DNA, 12 bp, synthetic construct
  misc_feature 1..12: note = Description of Artificial Sequence: Synthetic oligonucleotide
  source 1..12: mol_type = other DNA
gaacgcaattcc

SEQ ID NO: 2349 - DNA, 12 bp, synthetic construct
  misc_feature 1..12: note = Description of Artificial Sequence: Synthetic oligonucleotide
  source 1..12: mol_type = other DNA
gagcgtatccat

SEQ ID NO: 2350 - DNA, 12 bp, synthetic construct
  misc_feature 1..12: note = Description of Artificial Sequence: Synthetic oligonucleotide
  source 1..12: mol_type = other DNA
acacctgcgatc

SEQ ID NO: 2351 - DNA, 12 bp, synthetic construct
  misc_feature 1..12: note = Description of Artificial Sequence: Synthetic oligonucleotide
  source 1..12: mol_type = other DNA
tcgtaagccgtc

SEQ ID NO: 2352 - DNA, 12 bp, synthetic construct
  misc_feature 1..12: note = Description of Artificial Sequence: Synthetic oligonucleotide
  source 1..12: mol_type = other DNA
gtgtacataacg

SEQ ID NO: 2353 - DNA, 12 bp, synthetic construct
  misc_feature 1..12: note = Description of Artificial Sequence: Synthetic oligonucleotide
  source 1..12: mol_type = other DNA
atccgtctgacg

SEQ ID NO: 2354 - DNA, 12 bp, synthetic construct
  misc_feature 1..12: note = Description of Artificial Sequence: Synthetic oligonucleotide
  source 1..12: mol_type = other DNA
atgggcgaatgg

SEQ ID NO: 2355 - DNA, 12 bp, synthetic construct
  misc_feature 1..12: note = Description of Artificial Sequence: Synthetic oligonucleotide
  source 1..12: mol_type = other DNA
ggcgttgcattc

SEQ ID NO: 2356 - DNA, 12 bp, synthetic construct
  misc_feature 1..12: note = Description of Artificial Sequence: Synthetic oligonucleotide
  source 1..12: mol_type = other DNA
tgacgcctccaa

SEQ ID NO: 2357 - DNA, 12 bp, synthetic construct
  misc_feature 1..12: note = Description of Artificial Sequence: Synthetic oligonucleotide
  source 1..12: mol_type = other DNA
tgctgctcaacg

SEQ ID NO: 2358 - DNA, 12 bp, synthetic construct
  misc_feature 1..12: note = Description of Artificial Sequence: Synthetic oligonucleotide
  source 1..12: mol_type = other DNA
tgaaatgtcccg

SEQ ID NO: 2359 - DNA, 12 bp, synthetic construct
  misc_feature 1..12: note = Description of Artificial Sequence: Synthetic oligonucleotide
  source 1..12: mol_type = other DNA
gatctctgggta

SEQ ID NO: 2360 - DNA, 12 bp, synthetic construct
  misc_feature 1..12: note = Description of Artificial Sequence: Synthetic oligonucleotide
  source 1..12: mol_type = other DNA
actagcgttcag

SEQ ID NO: 2361 - DNA, 12 bp, synthetic construct
  misc_feature 1..12: note = Description of Artificial Sequence: Synthetic oligonucleotide
  source 1..12: mol_type = other DNA
ttctcggttctc

SEQ ID NO: 2362 - DNA, 12 bp, synthetic construct
  misc_feature 1..12: note = Description of Artificial Sequence: Synthetic oligonucleotide
  source 1..12: mol_type = other DNA
cggatgcaagag

SEQ ID NO: 2363 - DNA, 12 bp, synthetic construct
  misc_feature 1..12: note = Description of Artificial Sequence: Synthetic oligonucleotide
  source 1..12: mol_type = other DNA
attcgccaagaa

SEQ ID NO: 2364 - DNA, 12 bp, synthetic construct
  misc_feature 1..12: note = Description of Artificial Sequence: Synthetic oligonucleotide
  source 1..12: mol_type = other DNA
catcatacgggt

SEQ ID NO: 2365 - DNA, 12 bp, synthetic construct
  misc_feature 1..12: note = Description of Artificial Sequence: Synthetic oligonucleotide
  source 1..12: mol_type = other DNA
ttgcgacaaagt

SEQ ID NO: 2366 - DNA, 12 bp, synthetic construct
  misc_feature 1..12: note = Description of Artificial Sequence: Synthetic oligonucleotide
  source 1..12: mol_type = other DNA
gctactggtatg

SEQ ID NO: 2367 - DNA, 12 bp, synthetic construct
  misc_feature 1..12: note = Description of Artificial Sequence: Synthetic oligonucleotide
  source 1..12: mol_type = other DNA
tgacattcacgg

SEQ ID NO: 2368 - DNA, 12 bp, synthetic construct
  misc_feature 1..12: note = Description of Artificial Sequence: Synthetic oligonucleotide
  source 1..12: mol_type = other DNA
tacgtgatcccg

SEQ ID NO: 2369 - DNA, 12 bp, synthetic construct
  misc_feature 1..12: note = Description of Artificial Sequence: Synthetic oligonucleotide
  source 1..12: mol_type = other DNA
tacggattatgg

SEQ ID NO: 2370 - DNA, 12 bp, synthetic construct
  misc_feature 1..12: note = Description of Artificial Sequence: Synthetic oligonucleotide
  source 1..12: mol_type = other DNA
tgcgagtatatg

SEQ ID NO: 2371 - DNA, 12 bp, synthetic construct
  misc_feature 1..12: note = Description of Artificial Sequence: Synthetic oligonucleotide
  source 1..12: mol_type = other DNA
gaatcctcaccg

SEQ ID NO: 2372 - DNA, 12 bp, synthetic construct
  misc_feature 1..12: note = Description of Artificial Sequence: Synthetic oligonucleotide
  source 1..12: mol_type = other DNA
cacatattgggc

SEQ ID NO: 2373 - DNA, 12 bp, synthetic construct
  misc_feature 1..12: note = Description of Artificial Sequence: Synthetic oligonucleotide
  source 1..12: mol_type = other DNA
tgggtagatctc

SEQ ID NO: 2374 - DNA, 12 bp, synthetic construct
  misc_feature 1..12: note = Description of Artificial Sequence: Synthetic oligonucleotide
  source 1..12: mol_type = other DNA
atagcgaactca

SEQ ID NO: 2375 - DNA, 12 bp, synthetic construct
  misc_feature 1..12: note = Description of Artificial Sequence: Synthetic oligonucleotide
  source 1..12: mol_type = other DNA
taccacaacgaa

SEQ ID NO: 2376 - DNA, 12 bp, synthetic construct
  misc_feature 1..12: note = Description of Artificial Sequence: Synthetic oligonucleotide
  source 1..12: mol_type = other DNA
cctgacacacac

SEQ ID NO: 2377 - DNA, 12 bp, synthetic construct
  misc_feature 1..12: note = Description of Artificial Sequence: Synthetic oligonucleotide
  source 1..12: mol_type = other DNA
ttcaatagggac

SEQ ID NO: 2378 - DNA, 12 bp, synthetic construct
  misc_feature 1..12: note = Description of Artificial Sequence: Synthetic oligonucleotide
  source 1..12: mol_type = other DNA
agcaatcggtat

SEQ ID NO: 2379 - DNA, 12 bp, synthetic construct
  misc_feature 1..12: note = Description of Artificial Sequence: Synthetic oligonucleotide
  source 1..12: mol_type = other DNA
taacgctgtgtg

SEQ ID NO: 2380 - DNA, 12 bp, synthetic construct
  misc_feature 1..12: note = Description of Artificial Sequence: Synthetic oligonucleotide
  source 1..12: mol_type = other DNA
tctggaacggtt

SEQ ID NO: 2381 - DNA, 12 bp, synthetic construct
  misc_feature 1..12: note = Description of Artificial Sequence: Synthetic oligonucleotide
  source 1..12: mol_type = other DNA
cagcgtttagcc

SEQ ID NO: 2382 - DNA, 12 bp, synthetic construct
  misc_feature 1..12: note = Description of Artificial Sequence: Synthetic oligonucleotide
  source 1..12: mol_type = other DNA
atagccgatgtc

SEQ ID NO: 2383 - DNA, 12 bp, synthetic construct
  misc_feature 1..12: note = Description of Artificial Sequence: Synthetic oligonucleotide
  source 1..12: mol_type = other DNA
gttggacgaagg

SEQ ID NO: 2384 - DNA, 12 bp, synthetic construct
  misc_feature 1..12: note = Description of Artificial Sequence: Synthetic oligonucleotide
  source 1..12: mol_type = other DNA
aaccaaactcga

SEQ ID NO: 2385 - DNA, 12 bp, synthetic construct
  misc_feature 1..12: note = Description of Artificial Sequence: Synthetic oligonucleotide
  source 1..12: mol_type = other DNA
gtactacctcgg

SEQ ID NO: 2386 - DNA, 12 bp, synthetic construct
  misc_feature 1..12: note = Description of Artificial Sequence: Synthetic oligonucleotide
  source 1..12: mol_type = other DNA
ggtatggctact

SEQ ID NO: 2387 - DNA, 12 bp, synthetic construct
  misc_feature 1..12: note = Description of Artificial Sequence: Synthetic oligonucleotide
  source 1..12: mol_type = other DNA
atgcgtaatgca

SEQ ID NO: 2388 - DNA, 12 bp, synthetic construct
  misc_feature 1..12: note = Description of Artificial Sequence: Synthetic oligonucleotide
  source 1..12: mol_type = other DNA
acactatgaagc

SEQ ID NO: 2389 - DNA, 12 bp, synthetic construct
  misc_feature 1..12: note = Description of Artificial Sequence: Synthetic oligonucleotide
  source 1..12: mol_type = other DNA
gccgtctcgtaa

SEQ ID NO: 2390 - DNA, 12 bp, synthetic construct
  misc_feature 1..12: note = Description of Artificial Sequence: Synthetic oligonucleotide
  source 1..12: mol_type = other DNA
ttcctgttaacc

SEQ ID NO: 2391 - DNA, 12 bp, synthetic construct
  misc_feature 1..12: note = Description of Artificial Sequence: Synthetic oligonucleotide
  source 1..12: mol_type = other DNA
acaatgtcacag

SEQ ID NO: 2392 - DNA, 12 bp, synthetic construct
  misc_feature 1..12: note = Description of Artificial Sequence: Synthetic oligonucleotide
  source 1..12: mol_type = other DNA
actccgatagac

SEQ ID NO: 2393 - DNA, 12 bp, synthetic construct
  misc_feature 1..12: note = Description of Artificial Sequence: Synthetic oligonucleotide
  source 1..12: mol_type = other DNA
acggaaatccct

SEQ ID NO: 2394 - DNA, 12 bp, synthetic construct
  misc_feature 1..12: note = Description of Artificial Sequence: Synthetic oligonucleotide
  source 1..12: mol_type = other DNA
ctgggtatctcg

SEQ ID NO: 2395 - DNA, 12 bp, synthetic construct
  misc_feature 1..12: note = Description of Artificial Sequence: Synthetic oligonucleotide
  source 1..12: mol_type = other DNA
ctatccaagtgg

SEQ ID NO: 2396 - DNA, 12 bp, synthetic construct
  misc_feature 1..12: note = Description of Artificial Sequence: Synthetic oligonucleotide
  source 1..12: mol_type = other DNA
gccatagtgtgt

SEQ ID NO: 2397 - DNA, 12 bp, synthetic construct
  misc_feature 1..12: note = Description of Artificial Sequence: Synthetic oligonucleotide
  source 1..12: mol_type = other DNA
gctgagcctttg

SEQ ID NO: 2398 - DNA, 12 bp, synthetic construct
  misc_feature 1..12: note = Description of Artificial Sequence: Synthetic oligonucleotide
  source 1..12: mol_type = other DNA
ggtttctatcct

SEQ ID NO: 2399 - DNA, 12 bp, synthetic construct
  misc_feature 1..12: note = Description of Artificial Sequence: Synthetic oligonucleotide
  source 1..12: mol_type = other DNA
gactacccgttg

SEQ ID NO: 2400 - DNA, 12 bp, synthetic construct
  misc_feature 1..12: note = Description of Artificial Sequence: Synthetic oligonucleotide
  source 1..12: mol_type = other DNA
cagtctagtacg

SEQ ID NO: 2401 - DNA, 12 bp, synthetic construct
  misc_feature 1..12: note = Description of Artificial Sequence: Synthetic oligonucleotide
  source 1..12: mol_type = other DNA
ggtcccgaaatt

SEQ ID NO: 2402 - DNA, 12 bp, synthetic construct
  misc_feature 1..12: note = Description of Artificial Sequence: Synthetic oligonucleotide
  source 1..12: mol_type = other DNA
aacagagagagc

SEQ ID NO: 2403 - DNA, 12 bp, synthetic construct
  misc_feature 1..12: note = Description of Artificial Sequence: Synthetic oligonucleotide
  source 1..12: mol_type = other DNA
acgcaatgtctg

SEQ ID NO: 2404 - DNA, 12 bp, synthetic construct
  misc_feature 1..12: note = Description of Artificial Sequence: Synthetic oligonucleotide
  source 1..12: mol_type = other DNA
gcgttgcaaact

SEQ ID NO: 2405 - DNA, 12 bp, synthetic construct
  misc_feature 1..12: note = Description of Artificial Sequence: Synthetic oligonucleotide
  source 1..12: mol_type = other DNA
gtgtccggattc

SEQ ID NO: 2406 - DNA, 12 bp, synthetic construct
  misc_feature 1..12: note = Description of Artificial Sequence: Synthetic oligonucleotide
  source 1..12: mol_type = other DNA
tctgcgagtctg

SEQ ID NO: 2407 - DNA, 12 bp, synthetic construct
  misc_feature 1..12: note = Description of Artificial Sequence: Synthetic oligonucleotide
  source 1..12: mol_type = other DNA
aattccgaacgc

SEQ ID NO: 2408 - DNA, 12 bp, synthetic construct
  misc_feature 1..12: note = Description of Artificial Sequence: Synthetic oligonucleotide
  source 1..12: mol_type = other DNA
tcggttacgctg

SEQ ID NO: 2409 - DNA, 12 bp, synthetic construct
  misc_feature 1..12: note = Description of Artificial Sequence: Synthetic oligonucleotide
  source 1..12: mol_type = other DNA
aaccgcataagt

SEQ ID NO: 2410 - DNA, 12 bp, synthetic construct
  misc_feature 1..12: note = Description of Artificial Sequence: Synthetic oligonucleotide
  source 1..12: mol_type = other DNA
tgtggtgatgta

SEQ ID NO: 2411 - DNA, 12 bp, synthetic construct
  misc_feature 1..12: note = Description of Artificial Sequence: Synthetic oligonucleotide
  source 1..12: mol_type = other DNA
atgtaggcttag

SEQ ID NO: 2412 - DNA, 12 bp, synthetic construct
  misc_feature 1..12: note = Description of Artificial Sequence: Synthetic oligonucleotide
  source 1..12: mol_type = other DNA
ttagtacgcaga

SEQ ID NO: 2413 - DNA, 12 bp, synthetic construct
  misc_feature 1..12: note = Description of Artificial Sequence: Synthetic oligonucleotide
  source 1..12: mol_type = other DNA
aagccattgaac

SEQ ID NO: 2414 - DNA, 12 bp, synthetic construct
  misc_feature 1..12: note = Description of Artificial Sequence: Synthetic oligonucleotide
  source 1..12: mol_type = other DNA
accttacacctt

SEQ ID NO: 2415 - DNA, 12 bp, synthetic construct
  misc_feature 1..12: note = Description of Artificial Sequence: Synthetic oligonucleotide
  source 1..12: mol_type = other DNA
ctttcgttcaac

SEQ ID NO: 2416 - DNA, 12 bp, synthetic construct
  misc_feature 1..12: note = Description of Artificial Sequence: Synthetic oligonucleotide
  source 1..12: mol_type = other DNA
tgcttccaattc

SEQ ID NO: 2417 - DNA, 12 bp, synthetic construct
  misc_feature 1..12: note = Description of Artificial Sequence: Synthetic oligonucleotide
  source 1..12: mol_type = other DNA
gaatctgacaac

SEQ ID NO: 2418 - DNA, 12 bp, synthetic construct
  misc_feature 1..12: note = Description of Artificial Sequence: Synthetic oligonucleotide
  source 1..12: mol_type = other DNA
cgattgttccgg

SEQ ID NO: 2419 - DNA, 12 bp, synthetic construct
  misc_feature 1..12: note = Description of Artificial Sequence: Synthetic oligonucleotide
  source 1..12: mol_type = other DNA
gtaggtgcttac

SEQ ID NO: 2420 - DNA, 12 bp, synthetic construct
  misc_feature 1..12: note = Description of Artificial Sequence: Synthetic oligonucleotide
  source 1..12: mol_type = other DNA
ccgaagattctg

SEQ ID NO: 2421 - DNA, 12 bp, synthetic construct
  misc_feature 1..12: note = Description of Artificial Sequence: Synthetic oligonucleotide
  source 1..12: mol_type = other DNA
gccgagataatt

SEQ ID NO: 2422 - DNA, 12 bp, synthetic construct
  misc_feature 1..12: note = Description of Artificial Sequence: Synthetic oligonucleotide
  source 1..12: mol_type = other DNA
cacactgaagtc

SEQ ID NO: 2423 - DNA, 12 bp, synthetic construct
  misc_feature 1..12: note = Description of Artificial Sequence: Synthetic oligonucleotide
  source 1..12: mol_type = other DNA
cctaagagcatc

SEQ ID NO: 2424 - DNA, 12 bp, synthetic construct
  misc_feature 1..12: note = Description of Artificial Sequence: Synthetic oligonucleotide
  source 1..12: mol_type = other DNA
cgcatttggatg

SEQ ID NO: 2425 - DNA, 12 bp, synthetic construct
  misc_feature 1..12: note = Description of Artificial Sequence: Synthetic oligonucleotide
  source 1..12: mol_type = other DNA
gttggcgttaca

SEQ ID NO: 2426 - DNA, 12 bp, synthetic construct
  misc_feature 1..12: note = Description of Artificial Sequence: Synthetic oligonucleotide
  source 1..12: mol_type = other DNA
tcgagtatcgaa

SEQ ID NO: 2427 - DNA, 12 bp, synthetic construct
  misc_feature 1..12: note = Description of Artificial Sequence: Synthetic oligonucleotide
  source 1..12: mol_type = other DNA
actatcagtggc

SEQ ID NO: 2428 - DNA, 12 bp, synthetic construct
  misc_feature 1..12: note = Description of Artificial Sequence: Synthetic oligonucleotide
  source 1..12: mol_type = other DNA
gatggtttcagc

SEQ ID NO: 2429 - DNA, 12 bp, synthetic construct
  misc_feature 1..12: note = Description of Artificial Sequence: Synthetic oligonucleotide
  source 1..12: mol_type = other DNA
ataacatgtgcg

SEQ ID NO: 2430 - DNA, 12 bp, synthetic construct
  misc_feature 1..12: note = Description of Artificial Sequence: Synthetic oligonucleotide
  source 1..12: mol_type = other DNA
gaagtagcgagc

SEQ ID NO: 2431 - DNA, 12 bp, synthetic construct
  misc_feature 1..12: note = Description of Artificial Sequence: Synthetic oligonucleotide
  source 1..12: mol_type = other DNA
gccctatcttct

SEQ ID NO: 2432 - DNA, 12 bp, synthetic construct
  misc_feature 1..12: note = Description of Artificial Sequence: Synthetic oligonucleotide
  source 1..12: mol_type = other DNA
agactcagactc

SEQ ID NO: 2433 - DNA, 12 bp, synthetic construct
  misc_feature 1..12: note = Description of Artificial Sequence: Synthetic oligonucleotide
  source 1..12: mol_type = other DNA
taattgcagagc

SEQ ID NO: 2434 - DNA, 12 bp, synthetic construct
  misc_feature 1..12: note = Description of Artificial Sequence: Synthetic oligonucleotide
  source 1..12: mol_type = other DNA
cttgagaaatcg

SEQ ID NO: 2435 - DNA, 12 bp, synthetic construct
  misc_feature 1..12: note = Description of Artificial Sequence: Synthetic oligonucleotide
  source 1..12: mol_type = other DNA
ttgcggacccta

SEQ ID NO: 2436 - DNA, 12 bp, synthetic construct
  misc_feature 1..12: note = Description of Artificial Sequence: Synthetic oligonucleotide
  source 1..12: mol_type = other DNA
aggtacgcaatt

SEQ ID NO: 2437 - DNA, 12 bp, synthetic construct
  misc_feature 1..12: note = Description of Artificial Sequence: Synthetic oligonucleotide
  source 1..12: mol_type = other DNA
gacctttcaagg

SEQ ID NO: 2438 - DNA, 12 bp, synthetic construct
  misc_feature 1..12: note = Description of Artificial Sequence: Synthetic oligonucleotide
  source 1..12: mol_type = other DNA
taccggcttgca

SEQ ID NO: 2439 - DNA, 12 bp, synthetic construct
  misc_feature 1..12: note = Description of Artificial Sequence: Synthetic oligonucleotide
  source 1..12: mol_type = other DNA
ctacacagcaca

SEQ ID NO: 2440 - DNA, 12 bp, synthetic construct
  misc_feature 1..12: note = Description of Artificial Sequence: Synthetic oligonucleotide
  source 1..12: mol_type = other DNA
gcggaaacatgg

SEQ ID NO: 2441 - DNA, 12 bp, synthetic construct
  misc_feature 1..12: note = Description of Artificial Sequence: Synthetic oligonucleotide
  source 1..12: mol_type = other DNA
gtccctattatc

SEQ ID NO: 2442 - DNA, 12 bp, synthetic construct
  misc_feature 1..12: note = Description of Artificial Sequence: Synthetic oligonucleotide
  source 1..12: mol_type = other DNA
caagcaggtgag

SEQ ID NO: 2443 - DNA, 12 bp, synthetic construct
  misc_feature 1..12: note = Description of Artificial Sequence: Synthetic oligonucleotide
  source 1..12: mol_type = other DNA
agtcggcatctc

SEQ ID NO: 2444 - DNA, 12 bp, synthetic construct
  misc_feature 1..12: note = Description of Artificial Sequence: Synthetic oligonucleotide
  source 1..12: mol_type = other DNA
gaaatgctacgt

SEQ ID NO: 2445 - DNA, 12 bp, synthetic construct
  misc_feature 1..12: note = Description of Artificial Sequence: Synthetic oligonucleotide
  source 1..12: mol_type = other DNA
aacgttagtgtg

SEQ ID NO: 2446 - DNA, 12 bp, synthetic construct
  misc_feature 1..12: note = Description of Artificial Sequence: Synthetic oligonucleotide
  source 1..12: mol_type = other DNA
tgggacatatcc

SEQ ID NO: 2447 - DNA, 12 bp, synthetic construct
  misc_feature 1..12: note = Description of Artificial Sequence: Synthetic oligonucleotide
  source 1..12: mol_type = other DNA
ggagaacgacac

SEQ ID NO: 2448 - DNA, 12 bp, synthetic construct
  misc_feature 1..12: note = Description of Artificial Sequence: Synthetic oligonucleotide
  source 1..12: mol_type = other DNA
atatacctgcgg

SEQ ID NO: 2449 - DNA, 12 bp, synthetic construct
  misc_feature 1..12: note = Description of Artificial Sequence: Synthetic oligonucleotide
  source 1..12: mol_type = other DNA
tctgaggttgcc

SEQ ID NO: 2450 - DNA, 12 bp, synthetic construct
  misc_feature 1..12: note = Description of Artificial Sequence: Synthetic oligonucleotide
  source 1..12: mol_type = other DNA
tgcatgacagtc

SEQ ID NO: 2451 - DNA, 12 bp, synthetic construct
  misc_feature 1..12: note = Description of Artificial Sequence: Synthetic oligonucleotide
  source 1..12: mol_type = other DNA
gaacgatcatgt

SEQ ID NO: 2452 - DNA, 12 bp, synthetic construct
  misc_feature 1..12: note = Description of Artificial Sequence: Synthetic oligonucleotide
  source 1..12: mol_type = other DNA
cagcttcgactg

SEQ ID NO: 2453 - DNA, 12 bp, synthetic construct
  misc_feature 1..12: note = Description of Artificial Sequence: Synthetic oligonucleotide
  source 1..12: mol_type = other DNA
tgtctgacgcaa

SEQ ID NO: 2454 - DNA, 12 bp, synthetic construct
  misc_feature 1..12: note = Description of Artificial Sequence: Synthetic oligonucleotide
  source 1..12: mol_type = other DNA
gatcattctctc

SEQ ID NO: 2455 - DNA, 12 bp, synthetic construct
  misc_feature 1..12: note = Description of Artificial Sequence: Synthetic oligonucleotide
  source 1..12: mol_type = other DNA
tcaatcgctttc

SEQ ID NO: 2456 - DNA, 12 bp, synthetic construct
  misc_feature 1..12: note = Description of Artificial Sequence: Synthetic oligonucleotide
  source 1..12: mol_type = other DNA
ttcagaccagcc

SEQ ID NO: 2457 - DNA, 12 bp, synthetic construct
  misc_feature 1..12: note = Description of Artificial Sequence: Synthetic oligonucleotide
  source 1..12: mol_type = other DNA
atctttccctga

SEQ ID NO: 2458 - DNA, 12 bp, synthetic construct
  misc_feature 1..12: note = Description of Artificial Sequence: Synthetic oligonucleotide
  source 1..12: mol_type = other DNA
catatccagccg

SEQ ID NO: 2459 - DNA, 12 bp, synthetic construct
  misc_feature 1..12: note = Description of Artificial Sequence: Synthetic oligonucleotide
  source 1..12: mol_type = other DNA
agacataccgta

SEQ ID NO: 2460 - DNA, 12 bp, synthetic construct
  misc_feature 1..12: note = Description of Artificial Sequence: Synthetic oligonucleotide
  source 1..12: mol_type = other DNA
ctaccgattgcg

SEQ ID NO: 2461 - DNA, 12 bp, synthetic construct
  misc_feature 1..12: note = Description of Artificial Sequence: Synthetic oligonucleotide
  source 1..12: mol_type = other DNA
acgcatcgcact

SEQ ID NO: 2462 - DNA, 12 bp, synthetic construct
  misc_feature 1..12: note = Description of Artificial Sequence: Synthetic oligonucleotide
  source 1..12: mol_type = other DNA
ctccgaacaaca

SEQ ID NO: 2463 - DNA, 12 bp, synthetic construct
  misc_feature 1..12: note = Description of Artificial Sequence: Synthetic oligonucleotide
  source 1..12: mol_type = other DNA
tctcactgttcc

SEQ ID NO: 2464 - DNA, 12 bp, synthetic construct
  misc_feature 1..12: note = Description of Artificial Sequence: Synthetic oligonucleotide
  source 1..12: mol_type = other DNA
gatcctcatgcg

SEQ ID NO: 2465 - DNA, 12 bp, synthetic construct
  misc_feature 1..12: note = Description of Artificial Sequence: Synthetic oligonucleotide
  source 1..12: mol_type = other DNA
tcacccaaggta

SEQ ID NO: 2466 - DNA, 12 bp, synthetic construct
  misc_feature 1..12: note = Description of Artificial Sequence: Synthetic oligonucleotide
  source 1..12: mol_type = other DNA
cagtagcgatat

SEQ ID NO: 2467 - DNA, 12 bp, synthetic construct
  misc_feature 1..12: note = Description of Artificial Sequence: Synthetic oligonucleotide
  source 1..12: mol_type = other DNA
ggtcacacatca

SEQ ID NO: 2468 - DNA, 12 bp, synthetic construct
  misc_feature 1..12: note = Description of Artificial Sequence: Synthetic oligonucleotide
  source 1..12: mol_type = other DNA
gctatggaactc

SEQ ID NO: 2469 - DNA, 12 bp, synthetic construct
  misc_feature 1..12: note = Description of Artificial Sequence: Synthetic oligonucleotide
  source 1..12: mol_type = other DNA
attatcgtccct

SEQ ID NO: 2470 - DNA, 12 bp, synthetic construct
  misc_feature 1..12: note = Description of Artificial Sequence: Synthetic oligonucleotide
  source 1..12: mol_type = other DNA
agccagtcatac

SEQ ID NO: 2471 - DNA, 12 bp, synthetic construct
  misc_feature 1..12: note = Description of Artificial Sequence: Synthetic oligonucleotide
  source 1..12: mol_type = other DNA
ggatactcgcat

SEQ ID NO: 2472 - DNA, 12 bp, synthetic construct
  misc_feature 1..12: note = Description of Artificial Sequence: Synthetic oligonucleotide
  source 1..12: mol_type = other DNA
agaacttgacgt

SEQ ID NO: 2473 - DNA, 12 bp, synthetic construct
  misc_feature 1..12: note = Description of Artificial Sequence: Synthetic oligonucleotide
  source 1..12: mol_type = other DNA
ctccacattcct

SEQ ID NO: 2474 - DNA, 12 bp, synthetic construct
  misc_feature 1..12: note = Description of Artificial Sequence: Synthetic oligonucleotide
  source 1..12: mol_type = other DNA
ccagaccgctat

SEQ ID NO: 2475 - DNA, 12 bp, synthetic construct
  misc_feature 1..12: note = Description of Artificial Sequence: Synthetic oligonucleotide
  source 1..12: mol_type = other DNA
taacggcgctct

SEQ ID NO: 2476 - DNA, 12 bp, synthetic construct
  misc_feature 1..12: note = Description of Artificial Sequence: Synthetic oligonucleotide
  source 1..12: mol_type = other DNA
ctaagttgcaag

SEQ ID NO: 2477 - DNA, 12 bp, synthetic construct
  misc_feature 1..12: note = Description of Artificial Sequence: Synthetic oligonucleotide
  source 1..12: mol_type = other DNA
cttgaacccgac

SEQ ID NO: 2478 - DNA, 12 bp, synthetic construct
  misc_feature 1..12: note = Description of Artificial Sequence: Synthetic oligonucleotide
  source 1..12: mol_type = other DNA
tacgtttggcga

SEQ ID NO: 2479 - DNA, 12 bp, synthetic construct
  misc_feature 1..12: note = Description of Artificial Sequence: Synthetic oligonucleotide
  source 1..12: mol_type = other DNA
agctctagaaac

SEQ ID NO: 2480 - DNA, 12 bp, synthetic construct
  misc_feature 1..12: note = Description of Artificial Sequence: Synthetic oligonucleotide
  source 1..12: mol_type = other DNA
gtttgctcgaga

SEQ ID NO: 2481 - DNA, 12 bp, synthetic construct
  misc_feature 1..12: note = Description of Artificial Sequence: Synthetic oligonucleotide
  source 1..12: mol_type = other DNA
cgcgatatcgtc

SEQ ID NO: 2482 - DNA, 12 bp, synthetic construct
  misc_feature 1..12: note = Description of Artificial Sequence: Synthetic oligonucleotide
  source 1..12: mol_type = other DNA
gacgtgtccatc

SEQ ID NO: 2483 - DNA, 12 bp, synthetic construct
  misc_feature 1..12: note = Description of Artificial Sequence: Synthetic oligonucleotide
  source 1..12: mol_type = other DNA
aatcgcccttgg

SEQ ID NO: 2484 - DNA, 12 bp, synthetic construct
  misc_feature 1..12: note = Description of Artificial Sequence: Synthetic oligonucleotide
  source 1..12: mol_type = other DNA
tccatcgacgtg

SEQ ID NO: 2485 - DNA, 12 bp, synthetic construct
  misc_feature 1..12: note = Description of Artificial Sequence: Synthetic oligonucleotide
  source 1..12: mol_type = other DNA
caaacgcactaa

SEQ ID NO: 2486 - DNA, 12 bp, synthetic construct
  misc_feature 1..12: note = Description of Artificial Sequence: Synthetic oligonucleotide
  source 1..12: mol_type = other DNA
ctgatgtacacg

SEQ ID NO: 2487 - DNA, 12 bp, synthetic construct
  misc_feature 1..12: note = Description of Artificial Sequence: Synthetic oligonucleotide
  source 1..12: mol_type = other DNA
agagccaagagc

SEQ ID NO: 2488 - DNA, 12 bp, synthetic construct
  misc_feature 1..12: note = Description of Artificial Sequence: Synthetic oligonucleotide
  source 1..12: mol_type = other DNA
cggcgatgaaag

SEQ ID NO: 2489 - DNA, 12 bp, synthetic construct
  misc_feature 1..12: note = Description of Artificial Sequence: Synthetic oligonucleotide
  source 1..12: mol_type = other DNA
cgatgtgtggtt

SEQ ID NO: 2490 - DNA, 12 bp, synthetic construct
  misc_feature 1..12: note = Description of Artificial Sequence: Synthetic oligonucleotide
  source 1..12: mol_type = other DNA
gaacaaagagcg

SEQ ID NO: 2491 - DNA, 12 bp, synthetic construct
  misc_feature 1..12: note = Description of Artificial Sequence: Synthetic oligonucleotide
  source 1..12: mol_type = other DNA
aggcatctgctc

SEQ ID NO: 2492 - DNA, 12 bp, synthetic construct
  misc_feature 1..12: note = Description of Artificial Sequence: Synthetic oligonucleotide
  source 1..12: mol_type = other DNA
tgggaatgttgt

SEQ ID NO: 2493 - DNA, 12 bp, synthetic construct
  misc_feature 1..12: note = Description of Artificial Sequence: Synthetic oligonucleotide
  source 1..12: mol_type = other DNA
ccgctacgtgat

SEQ ID NO: 2494 - DNA, 12 bp, synthetic construct
  misc_feature 1..12: note = Description of Artificial Sequence: Synthetic oligonucleotide
  source 1..12: mol_type = other DNA
gcgaagttggga

SEQ ID NO: 2495 - DNA, 12 bp, synthetic construct
  misc_feature 1..12: note = Description of Artificial Sequence: Synthetic oligonucleotide
  source 1..12: mol_type = other DNA
gctaagtgatgt

SEQ ID NO: 2496 - DNA, 12 bp, synthetic construct
  misc_feature 1..12: note = Description of Artificial Sequence: Synthetic oligonucleotide
  source 1..12: mol_type = other DNA
agacctgaccct

SEQ ID NO: 2497 - DNA, 12 bp, synthetic construct
  misc_feature 1..12: note = Description of Artificial Sequence: Synthetic oligonucleotide
  source 1..12: mol_type = other DNA
caatcataggtg

SEQ ID NO: 2498 - DNA, 12 bp, synthetic construct
  misc_feature 1..12: note = Description of Artificial Sequence: Synthetic oligonucleotide
  source 1..12: mol_type = other DNA
ctggtaagtcca

SEQ ID NO: 2499 - DNA, 12 bp, synthetic construct
  misc_feature 1..12: note = Description of Artificial Sequence: Synthetic oligonucleotide
  source 1..12: mol_type = other DNA
gcattcggcgtt

SEQ ID NO: 2500 - DNA, 12 bp, synthetic construct
  misc_feature 1..12: note = Description of Artificial Sequence: Synthetic oligonucleotide
  source 1..12: mol_type = other DNA
aagggacaagtg

SEQ ID NO: 2501 - DNA, 12 bp, synthetic construct
  misc_feature 1..12: note = Description of Artificial Sequence: Synthetic oligonucleotide
  source 1..12: mol_type = other DNA
catcgacgagtt

SEQ ID NO: 2502 - DNA, 12 bp, synthetic construct
  misc_feature 1..12: note = Description of Artificial Sequence: Synthetic oligonucleotide
  source 1..12: mol_type = other DNA
ataagtaaccgc

SEQ ID NO: 2503 - DNA, 12 bp, synthetic construct
  misc_feature 1..12: note = Description of Artificial Sequence: Synthetic oligonucleotide
  source 1..12: mol_type = other DNA
agagctcctctg

SEQ ID NO: 2504 - DNA, 12 bp, synthetic construct
  misc_feature 1..12: note = Description of Artificial Sequence: Synthetic oligonucleotide
  source 1..12: mol_type = other DNA
cgccattgtgca

SEQ ID NO: 2505 - DNA, 12 bp, synthetic construct
  misc_feature 1..12: note = Description of Artificial Sequence: Synthetic oligonucleotide
  source 1..12: mol_type = other DNA
agtgtcgattcg

SEQ ID NO: 2506 - DNA, 12 bp, synthetic construct
  misc_feature 1..12: note = Description of Artificial Sequence: Synthetic oligonucleotide
  source 1..12: mol_type = other DNA
ggagttgaggtg

SEQ ID NO: 2507 - DNA, 12 bp, synthetic construct
  misc_feature 1..12: note = Description of Artificial Sequence: Synthetic oligonucleotide
  source 1..12: mol_type = other DNA
gacttggtaaac

SEQ ID NO: 2508 - DNA, 12 bp, synthetic construct
  misc_feature 1..12: note = Description of Artificial Sequence: Synthetic oligonucleotide
  source 1..12: mol_type = other DNA
gacaaaccttgc

SEQ ID NO: 2509 - DNA, 12 bp, synthetic construct
  misc_feature 1..12: note = Description of Artificial Sequence: Synthetic oligonucleotide
  source 1..12: mol_type = other DNA
tccaactgcaga

SEQ ID NO: 2510 - DNA, 12 bp, synthetic construct
  misc_feature 1..12: note = Description of Artificial Sequence: Synthetic oligonucleotide
  source 1..12: mol_type = other DNA
ctattaagcggc

SEQ ID NO: 2511 - DNA, 12 bp, synthetic construct
  misc_feature 1..12: note = Description of Artificial Sequence: Synthetic oligonucleotide
  source 1..12: mol_type = other DNA
agcatccctaag

SEQ ID NO: 2512 - DNA, 12 bp, synthetic construct
  misc_feature 1..12: note = Description of Artificial Sequence: Synthetic oligonucleotide
  source 1..12: mol_type = other DNA
aatcacggtgct

SEQ ID NO: 2513 - DNA, 12 bp, synthetic construct
  misc_feature 1..12: note = Description of Artificial Sequence: Synthetic oligonucleotide
  source 1..12: mol_type = other DNA
cattagctggaa

SEQ ID NO: 2514 - DNA, 12 bp, synthetic construct
  misc_feature 1..12: note = Description of Artificial Sequence: Synthetic oligonucleotide
  source 1..12: mol_type = other DNA
taaagacccgta

SEQ ID NO: 2515 - DNA, 12 bp, synthetic construct
  misc_feature 1..12: note = Description of Artificial Sequence: Synthetic oligonucleotide
  source 1..12: mol_type = other DNA
cctaccattgtt

SEQ ID NO: 2516 - DNA, 12 bp, synthetic construct
  misc_feature 1..12: note = Description of Artificial Sequence: Synthetic oligonucleotide
  source 1..12: mol_type = other DNA
cagacgaggaac

SEQ ID NO: 2517 - DNA, 12 bp, synthetic construct
  misc_feature 1..12: note = Description of Artificial Sequence: Synthetic oligonucleotide
  source 1..12: mol_type = other DNA
acgacctacgct

SEQ ID NO: 2518 - DNA, 12 bp, synthetic construct
  misc_feature 1..12: note = Description of Artificial Sequence: Synthetic oligonucleotide
  source 1..12: mol_type = other DNA
ccacaacgatca

SEQ ID NO: 2519 - DNA, 12 bp, synthetic construct
  misc_feature 1..12: note = Description of Artificial Sequence: Synthetic oligonucleotide
  source 1..12: mol_type = other DNA
tgtatcttcacc

SEQ ID NO: 2520 - DNA, 12 bp, synthetic construct
  misc_feature 1..12: note = Description of Artificial Sequence: Synthetic oligonucleotide
  source 1..12: mol_type = other DNA
gagtccgttgct

SEQ ID NO: 2521 - DNA, 12 bp, synthetic construct
  misc_feature 1..12: note = Description of Artificial Sequence: Synthetic oligonucleotide
  source 1..12: mol_type = other DNA
tcgctacagatg

SEQ ID NO: 2522 - DNA, 12 bp, synthetic construct
  misc_feature 1..12: note = Description of Artificial Sequence: Synthetic oligonucleotide
  source 1..12: mol_type = other DNA
gatgtcatagcc

SEQ ID NO: 2523 - DNA, 12 bp, synthetic construct
  misc_feature 1..12: note = Description of Artificial Sequence: Synthetic oligonucleotide
  source 1..12: mol_type = other DNA
ccggtgtgattc

SEQ ID NO: 2524 - DNA, 12 bp, synthetic construct
  misc_feature 1..12: note = Description of Artificial Sequence: Synthetic oligonucleotide
  source 1..12: mol_type = other DNA
gactgactcgtc

SEQ ID NO: 2525 - DNA, 12 bp, synthetic construct
  misc_feature 1..12: note = Description of Artificial Sequence: Synthetic oligonucleotide
  source 1..12: mol_type = other DNA
gataactgtacg

SEQ ID NO: 2526 - DNA, 12 bp, synthetic construct
  misc_feature 1..12: note = Description of Artificial Sequence: Synthetic oligonucleotide
  source 1..12: mol_type = other DNA
tcggtgtaccaa

SEQ ID NO: 2527 - DNA, 12 bp, synthetic construct
  misc_feature 1..12: note = Description of Artificial Sequence: Synthetic oligonucleotide
  source 1..12: mol_type = other DNA
tgttgcgtttct

SEQ ID NO: 2528 - DNA, 12 bp, synthetic construct
  misc_feature 1..12: note = Description of Artificial Sequence: Synthetic oligonucleotide
  source 1..12: mol_type = other DNA
atagtgttcggc

SEQ ID NO: 2529 - DNA, 12 bp, synthetic construct
  misc_feature 1..12: note = Description of Artificial Sequence: Synthetic oligonucleotide
  source 1..12: mol_type = other DNA
tcgtggatagct

SEQ ID NO: 2530 - DNA, 12 bp, synthetic construct
  misc_feature 1..12: note = Description of Artificial Sequence: Synthetic oligonucleotide
  source 1..12: mol_type = other DNA
taaacctggaca

SEQ ID NO: 2531 - DNA, 12 bp, synthetic construct
  misc_feature 1..12: note = Description of Artificial Sequence: Synthetic oligonucleotide
  source 1..12: mol_type = other DNA
aacacggtttga

SEQ ID NO: 2532 - DNA, 12 bp, synthetic construct
  misc_feature 1..12: note = Description of Artificial Sequence: Synthetic oligonucleotide
  source 1..12: mol_type = other DNA
gcatactacagc

SEQ ID NO: 2533 - DNA, 12 bp, synthetic construct
  misc_feature 1..12: note = Description of Artificial Sequence: Synthetic oligonucleotide
  source 1..12: mol_type = other DNA
taatctcgccgg

SEQ ID NO: 2534 - DNA, 12 bp, synthetic construct
  misc_feature 1..12: note = Description of Artificial Sequence: Synthetic oligonucleotide
  source 1..12: mol_type = other DNA
gacgcactaact

SEQ ID NO: 2535 - DNA, 12 bp, synthetic construct
  misc_feature 1..12: note = Description of Artificial Sequence: Synthetic oligonucleotide
  source 1..12: mol_type = other DNA
ccgaattgacaa

SEQ ID NO: 2536 - DNA, 12 bp, synthetic construct
  misc_feature 1..12: note = Description of Artificial Sequence: Synthetic oligonucleotide
  source 1..12: mol_type = other DNA
cttgtgcgacaa

SEQ ID NO: 2537 - DNA, 12 bp, synthetic construct
  misc_feature 1..12: note = Description of Artificial Sequence: Synthetic oligonucleotide
  source 1..12: mol_type = other DNA
gaggtattctga

SEQ ID NO: 2538 - DNA, 12 bp, synthetic construct
  misc_feature 1..12: note = Description of Artificial Sequence: Synthetic oligonucleotide
  source 1..12: mol_type = other DNA
cagatcccaacc

SEQ ID NO: 2539 - DNA, 12 bp, synthetic construct
  misc_feature 1..12: note = Description of Artificial Sequence: Synthetic oligonucleotide
  source 1..12: mol_type = other DNA
ggcgatttacgt

SEQ ID NO: 2540 - DNA, 12 bp, synthetic construct
  misc_feature 1..12: note = Description of Artificial Sequence: Synthetic oligonucleotide
  source 1..12: mol_type = other DNA
ctggcatctagc

SEQ ID NO: 2541 - DNA, 12 bp, synthetic construct
  misc_feature 1..12: note = Description of Artificial Sequence: Synthetic oligonucleotide
  source 1..12: mol_type = other DNA
agagtaagccgg

SEQ ID NO: 2542 - DNA, 12 bp, synthetic construct
  misc_feature 1..12: note = Description of Artificial Sequence: Synthetic oligonucleotide
  source 1..12: mol_type = other DNA
atgttcctcatc

SEQ ID NO: 2543 - DNA, 12 bp, synthetic construct
  misc_feature 1..12: note = Description of Artificial Sequence: Synthetic oligonucleotide
  source 1..12: mol_type = other DNA
agagattatgcc

SEQ ID NO: 2544 - DNA, 12 bp, synthetic construct
  misc_feature 1..12: note = Description of Artificial Sequence: Synthetic oligonucleotide
  source 1..12: mol_type = other DNA
taaggcatcgct

SEQ ID NO: 2545 - DNA, 12 bp, synthetic construct
  misc_feature 1..12: note = Description of Artificial Sequence: Synthetic oligonucleotide
  source 1..12: mol_type = other DNA
ggtggtcgttct

SEQ ID NO: 2546 - DNA, 12 bp, synthetic construct
  misc_feature 1..12: note = Description of Artificial Sequence: Synthetic oligonucleotide
  source 1..12: mol_type = other DNA
agacaccaatgt

SEQ ID NO: 2547 - DNA, 12 bp, synthetic construct
  misc_feature 1..12: note = Description of Artificial Sequence: Synthetic oligonucleotide
  source 1..12: mol_type = other DNA
cggtatagcaat

SEQ ID NO: 2548 - DNA, 12 bp, synthetic construct
  misc_feature 1..12: note = Description of Artificial Sequence: Synthetic oligonucleotide
  source 1..12: mol_type = other DNA
tgaatacctggc

SEQ ID NO: 2549 - DNA, 12 bp, synthetic construct
  misc_feature 1..12: note = Description of Artificial Sequence: Synthetic oligonucleotide
  source 1..12: mol_type = other DNA
acccatacagcc

SEQ ID NO: 2550 - DNA, 12 bp, synthetic construct
  misc_feature 1..12: note = Description of Artificial Sequence: Synthetic oligonucleotide
  source 1..12: mol_type = other DNA
actatgggctaa

SEQ ID NO: 2551 - DNA, 12 bp, synthetic construct
  misc_feature 1..12: note = Description of Artificial Sequence: Synthetic oligonucleotide
  source 1..12: mol_type = other DNA
aatacgtcaagc

SEQ ID NO: 2552 - DNA, 12 bp, synthetic construct
  misc_feature 1..12: note = Description of Artificial Sequence: Synthetic oligonucleotide
  source 1..12: mol_type = other DNA
cttggcctgtag

SEQ ID NO: 2553 - DNA, 12 bp, synthetic construct
  misc_feature 1..12: note = Description of Artificial Sequence: Synthetic oligonucleotide
  source 1..12: mol_type = other DNA
ctcccactagag

SEQ ID NO: 2554 - DNA, 12 bp, synthetic construct
  misc_feature 1..12: note = Description of Artificial Sequence: Synthetic oligonucleotide
  source 1..12: mol_type = other DNA
cgcactacgcat

SEQ ID NO: 2555 - DNA, 12 bp, synthetic construct
  misc_feature 1..12: note = Description of Artificial Sequence: Synthetic oligonucleotide
  source 1..12: mol_type = other DNA
gcattgagttcg

SEQ ID NO: 2556 - DNA, 12 bp, synthetic construct
  misc_feature 1..12: note = Description of Artificial Sequence: Synthetic oligonucleotide
  source 1..12: mol_type = other DNA
atggcaattcag

SEQ ID NO: 2557 - DNA, 12 bp, synthetic construct
  misc_feature 1..12: note = Description of Artificial Sequence: Synthetic oligonucleotide
  source 1..12: mol_type = other DNA
atcaaacgcatg

SEQ ID NO: 2558 - DNA, 12 bp, synthetic construct
  misc_feature 1..12: note = Description of Artificial Sequence: Synthetic oligonucleotide
  source 1..12: mol_type = other DNA
agccctgctaca

SEQ ID NO: 2559 - DNA, 12 bp, synthetic construct
  misc_feature 1..12: note = Description of Artificial Sequence: Synthetic oligonucleotide
  source 1..12: mol_type = other DNA
cagtcgttaaga

SEQ ID NO: 2560 - DNA, 12 bp, synthetic construct
  misc_feature 1..12: note = Description of Artificial Sequence: Synthetic oligonucleotide
  source 1..12: mol_type = other DNA
gttgctgagtcc

SEQ ID NO: 2561 - DNA, 12 bp, synthetic construct
  misc_feature 1..12: note = Description of Artificial Sequence: Synthetic oligonucleotide
  source 1..12: mol_type = other DNA
cagtgtcatgaa

SEQ ID NO: 2562 - DNA, 12 bp, synthetic construct
  misc_feature 1..12: note = Description of Artificial Sequence: Synthetic oligonucleotide
  source 1..12: mol_type = other DNA
cggtcctgagtt

SEQ ID NO: 2563 - DNA, 12 bp, synthetic construct
  misc_feature 1..12: note = Description of Artificial Sequence: Synthetic oligonucleotide
  source 1..12: mol_type = other DNA
ccttatagaagg

SEQ ID NO: 2564 - DNA, 12 bp, synthetic construct
  misc_feature 1..12: note = Description of Artificial Sequence: Synthetic oligonucleotide
  source 1..12: mol_type = other DNA
ctacgaaagcct

SEQ ID NO: 2565 - DNA, 12 bp, synthetic construct
  misc_feature 1..12: note = Description of Artificial Sequence: Synthetic oligonucleotide
  source 1..12: mol_type = other DNA
ctatggtgaacc

SEQ ID NO: 2566 - DNA, 12 bp, synthetic construct
  misc_feature 1..12: note = Description of Artificial Sequence: Synthetic oligonucleotide
  source 1..12: mol_type = other DNA
cggtgacctact

SEQ ID NO: 2567 - DNA, 12 bp, synthetic construct
  misc_feature 1..12: note = Description of Artificial Sequence: Synthetic oligonucleotide
  source 1..12: mol_type = other DNA
ctcgagcgtact

SEQ ID NO: 2568 - DNA, 12 bp, synthetic construct
  misc_feature 1..12: note = Description of Artificial Sequence: Synthetic oligonucleotide
  source 1..12: mol_type = other DNA
ggccaaggaagt

SEQ ID NO: 2569 - DNA, 12 bp, synthetic construct
  misc_feature 1..12: note = Description of Artificial Sequence: Synthetic oligonucleotide
  source 1..12: mol_type = other DNA
ataattgccgag

SEQ ID NO: 2570 - DNA, 12 bp, synthetic construct
  misc_feature 1..12: note = Description of Artificial Sequence: Synthetic oligonucleotide
  source 1..12: mol_type = other DNA
ggaccaagggat

SEQ ID NO: 2571 - DNA, 12 bp, synthetic construct
  misc_feature 1..12: note = Description of Artificial Sequence: Synthetic oligonucleotide
  source 1..12: mol_type = other DNA
acatccctactt

SEQ ID NO: 2572 - DNA, 12 bp, synthetic construct
  misc_feature 1..12: note = Description of Artificial Sequence: Synthetic oligonucleotide
  source 1..12: mol_type = other DNA
ttaaggactgac

SEQ ID NO: 2573 - DNA, 12 bp, synthetic construct
  misc_feature 1..12: note = Description of Artificial Sequence: Synthetic oligonucleotide
  source 1..12: mol_type = other DNA
cctctactctaa

SEQ ID NO: 2574 - DNA, 12 bp, synthetic construct
  misc_feature 1..12: note = Description of Artificial Sequence: Synthetic oligonucleotide
  source 1..12: mol_type = other DNA
ggcatgttatcg

SEQ ID NO: 2575 - DNA, 12 bp, synthetic construct
  misc_feature 1..12: note = Description of Artificial Sequence: Synthetic oligonucleotide
  source 1..12: mol_type = other DNA
gtattggtcaga

SEQ ID NO: 2576 - DNA, 12 bp, synthetic construct
  misc_feature 1..12: note = Description of Artificial Sequence: Synthetic oligonucleotide
  source 1..12: mol_type = other DNA
tgaagcacacta

SEQ ID NO: 2577 - DNA, 12 bp, synthetic construct
  misc_feature 1..12: note = Description of Artificial Sequence: Synthetic oligonucleotide
  source 1..12: mol_type = other DNA
gtggaagagaca

SEQ ID NO: 2578 - DNA, 12 bp, synthetic construct
  misc_feature 1..12: note = Description of Artificial Sequence: Synthetic oligonucleotide
  source 1..12: mol_type = other DNA
gagtcgatcttg

SEQ ID NO: 2579 - DNA, 12 bp, synthetic construct
  misc_feature 1..12: note = Description of Artificial Sequence: Synthetic oligonucleotide
  source 1..12: mol_type = other DNA
aggcacagtagg

SEQ ID NO: 2580 - DNA, 12 bp, synthetic construct
  misc_feature 1..12: note = Description of Artificial Sequence: Synthetic oligonucleotide
  source 1..12: mol_type = other DNA
agaaccgtcata

SEQ ID NO: 2581 - DNA, 12 bp, synthetic construct
  misc_feature 1..12: note = Description of Artificial Sequence: Synthetic oligonucleotide
  source 1..12: mol_type = other DNA
gtgaatgttcga

SEQ ID NO: 2582 - DNA, 12 bp, synthetic construct
  misc_feature 1..12: note = Description of Artificial Sequence: Synthetic oligonucleotide
  source 1..12: mol_type = other DNA
taactaggacgt

SEQ ID NO: 2583 - DNA, 12 bp, synthetic construct
  misc_feature 1..12: note = Description of Artificial Sequence: Synthetic oligonucleotide
  source 1..12: mol_type = other DNA
gacctaccgcat

SEQ ID NO: 2584 - DNA, 12 bp, synthetic construct
  misc_feature 1..12: note = Description of Artificial Sequence: Synthetic oligonucleotide
  source 1..12: mol_type = other DNA
ctacttacatcc

SEQ ID NO: 2585 - DNA, 12 bp, synthetic construct
  misc_feature 1..12: note = Description of Artificial Sequence: Synthetic oligonucleotide
  source 1..12: mol_type = other DNA
aactggaaccct

SEQ ID NO: 2586 - DNA, 12 bp, synthetic construct
  misc_feature 1..12: note = Description of Artificial Sequence: Synthetic oligonucleotide
  source 1..12: mol_type = other DNA
agtcgctacaca

SEQ ID NO: 2587 - DNA, 12 bp, synthetic construct
  misc_feature 1..12: note = Description of Artificial Sequence: Synthetic oligonucleotide
  source 1..12: mol_type = other DNA
gaaagagtctct

SEQ ID NO: 2588 - DNA, 12 bp, synthetic construct
  misc_feature 1..12: note = Description of Artificial Sequence: Synthetic oligonucleotide
  source 1..12: mol_type = other DNA
atgtaataggcc

SEQ ID NO: 2589 - DNA, 12 bp, synthetic construct
  misc_feature 1..12: note = Description of Artificial Sequence: Synthetic oligonucleotide
  source 1..12: mol_type = other DNA
ctcttctgatca

SEQ ID NO: 2590 - DNA, 12 bp, synthetic construct
  misc_feature 1..12: note = Description of Artificial Sequence: Synthetic oligonucleotide
  source 1..12: mol_type = other DNA
atactcggctgc

SEQ ID NO: 2591 - DNA, 12 bp, synthetic construct
  misc_feature 1..12: note = Description of Artificial Sequence: Synthetic oligonucleotide
  source 1..12: mol_type = other DNA
aaccactaaccg

SEQ ID NO: 2592 - DNA, 12 bp, synthetic construct
  misc_feature 1..12: note = Description of Artificial Sequence: Synthetic oligonucleotide
  source 1..12: mol_type = other DNA
tcaccggaatcc

SEQ ID NO: 2593 - DNA, 12 bp, synthetic construct
  misc_feature 1..12: note = Description of Artificial Sequence: Synthetic oligonucleotide
  source 1..12: mol_type = other DNA
gactcgcaacta

SEQ ID NO: 2594 - DNA, 12 bp, synthetic construct
  misc_feature 1..12: note = Description of Artificial Sequence: Synthetic oligonucleotide
  source 1..12: mol_type = other DNA
atgctaaccacg

SEQ ID NO: 2595 - DNA, 12 bp, synthetic construct
  misc_feature 1..12: note = Description of Artificial Sequence: Synthetic oligonucleotide
  source 1..12: mol_type = other DNA
acgcttaacgac

SEQ ID NO: 2596 - DNA, 12 bp, synthetic construct
  misc_feature 1..12: note = Description of Artificial Sequence: Synthetic oligonucleotide
  source 1..12: mol_type = other DNA
ttcgctaacctt

SEQ ID NO: 2597 - DNA, 12 bp, synthetic construct
  misc_feature 1..12: note = Description of Artificial Sequence: Synthetic oligonucleotide
  source 1..12: mol_type = other DNA
cgactgcagctt

SEQ ID NO: 2598 - DNA, 12 bp, synthetic construct
  misc_feature 1..12: note = Description of Artificial Sequence: Synthetic oligonucleotide
  source 1..12: mol_type = other DNA
ctgacgatccgt

SEQ ID NO: 2599 - DNA, 12 bp, synthetic construct
  misc_feature 1..12: note = Description of Artificial Sequence: Synthetic oligonucleotide
  source 1..12: mol_type = other DNA
accaatctcggc

SEQ ID NO: 2600 - DNA, 12 bp, synthetic construct
  misc_feature 1..12: note = Description of Artificial Sequence: Synthetic oligonucleotide
  source 1..12: mol_type = other DNA
agcttaccgacc

SEQ ID NO: 2601 - DNA, 12 bp, synthetic construct
  misc_feature 1..12: note = Description of Artificial Sequence: Synthetic oligonucleotide
  source 1..12: mol_type = other DNA
gacactcaccgt

SEQ ID NO: 2602 - DNA, 12 bp, synthetic construct
  misc_feature 1..12: note = Description of Artificial Sequence: Synthetic oligonucleotide
  source 1..12: mol_type = other DNA
gttacccgagct

SEQ ID NO: 2603 - DNA, 12 bp, synthetic construct
  misc_feature 1..12: note = Description of Artificial Sequence: Synthetic oligonucleotide
  source 1..12: mol_type = other DNA
gtgcgaggacaa

SEQ ID NO: 2604 - DNA, 12 bp, synthetic construct
  misc_feature 1..12: note = Description of Artificial Sequence: Synthetic oligonucleotide
  source 1..12: mol_type = other DNA
tatccaagcgca

SEQ ID NO: 2605 - DNA, 12 bp, synthetic construct
  misc_feature 1..12: note = Description of Artificial Sequence: Synthetic oligonucleotide
  source 1..12: mol_type = other DNA
agggctatagtt

SEQ ID NO: 2606 - DNA, 12 bp, synthetic construct
  misc_feature 1..12: note = Description of Artificial Sequence: Synthetic oligonucleotide
  source 1..12: mol_type = other DNA
tcagagtagact

SEQ ID NO: 2607 - DNA, 12 bp, synthetic construct
  misc_feature 1..12: note = Description of Artificial Sequence: Synthetic oligonucleotide
  source 1..12: mol_type = other DNA
cctaggtcccaa

SEQ ID NO: 2608 - DNA, 12 bp, synthetic construct
  misc_feature 1..12: note = Description of Artificial Sequence: Synthetic oligonucleotide
  source 1..12: mol_type = other DNA
gcagagaggcta

SEQ ID NO: 2609 - DNA, 12 bp, synthetic construct
  misc_feature 1..12: note = Description of Artificial Sequence: Synthetic oligonucleotide
  source 1..12: mol_type = other DNA
gtactgaagatc

SEQ ID NO: 2610 - DNA, 12 bp, synthetic construct
  misc_feature 1..12: note = Description of Artificial Sequence: Synthetic oligonucleotide
  source 1..12: mol_type = other DNA
tgtctcgcaagc

SEQ ID NO: 2611 - DNA, 12 bp, synthetic construct
  misc_feature 1..12: note = Description of Artificial Sequence: Synthetic oligonucleotide
  source 1..12: mol_type = other DNA
gaccaaatgtcc

SEQ ID NO: 2612 - DNA, 12 bp, synthetic construct
  misc_feature 1..12: note = Description of Artificial Sequence: Synthetic oligonucleotide
  source 1..12: mol_type = other DNA
ttgagtggtctg

SEQ ID NO: 2613 - DNA, 12 bp, synthetic construct
  misc_feature 1..12: note = Description of Artificial Sequence: Synthetic oligonucleotide
  source 1..12: mol_type = other DNA
tccttgtccttg

SEQ ID NO: 2614 - DNA, 12 bp, synthetic construct
  misc_feature 1..12: note = Description of Artificial Sequence: Synthetic oligonucleotide
  source 1..12: mol_type = other DNA
tcgccgtgtaca

SEQ ID NO: 2615 - DNA, 12 bp, synthetic construct
  misc_feature 1..12: note = Description of Artificial Sequence: Synthetic oligonucleotide
  source 1..12: mol_type = other DNA
cagccgcatatc

SEQ ID NO: 2616 - DNA, 12 bp, synthetic construct
  misc_feature 1..12: note = Description of Artificial Sequence: Synthetic oligonucleotide
  source 1..12: mol_type = other DNA
gatgcaacttcg

SEQ ID NO: 2617 - DNA, 12 bp, synthetic construct
  misc_feature 1..12: note = Description of Artificial Sequence: Synthetic oligonucleotide
  source 1..12: mol_type = other DNA
cgacgagattat

SEQ ID NO: 2618 - DNA, 12 bp, synthetic construct
  misc_feature 1..12: note = Description of Artificial Sequence: Synthetic oligonucleotide
  source 1..12: mol_type = other DNA
ctacaattgagg

SEQ ID NO: 2619 - DNA, 12 bp, synthetic construct
  misc_feature 1..12: note = Description of Artificial Sequence: Synthetic oligonucleotide
  source 1..12: mol_type = other DNA
aactgcgatatg

SEQ ID NO: 2620 - DNA, 12 bp, synthetic construct
  misc_feature 1..12: note = Description of Artificial Sequence: Synthetic oligonucleotide
  source 1..12: mol_type = other DNA
gatacgttcgca

SEQ ID NO: 2621 - DNA, 12 bp, synthetic construct
  misc_feature 1..12: note = Description of Artificial Sequence: Synthetic oligonucleotide
  source 1..12: mol_type = other DNA
caccacagaatc

SEQ ID NO: 2622 - DNA, 12 bp, synthetic construct
  misc_feature 1..12: note = Description of Artificial Sequence: Synthetic oligonucleotide
  source 1..12: mol_type = other DNA
agtactgcctgc

SEQ ID NO: 2623 - DNA, 12 bp, synthetic construct
  misc_feature 1..12: note = Description of Artificial Sequence: Synthetic oligonucleotide
  source 1..12: mol_type = other DNA
gttgaccatcgc

SEQ ID NO: 2624 - DNA, 12 bp, synthetic construct
  misc_feature 1..12: note = Description of Artificial Sequence: Synthetic oligonucleotide
  source 1..12: mol_type = other DNA
cttccaactcat

SEQ ID NO: 2625 - DNA, 12 bp, synthetic construct
  misc_feature 1..12: note = Description of Artificial Sequence: Synthetic oligonucleotide
  source 1..12: mol_type = other DNA
ccaagattcgcc

SEQ ID NO: 2626 - DNA, 12 bp, synthetic construct
  misc_feature 1..12: note = Description of Artificial Sequence: Synthetic oligonucleotide
  source 1..12: mol_type = other DNA
ggagctctgtat

SEQ ID NO: 2627 - DNA, 12 bp, synthetic construct
  misc_feature 1..12: note = Description of Artificial Sequence: Synthetic oligonucleotide
  source 1..12: mol_type = other DNA
gaagtccacact

SEQ ID NO: 2628 - DNA, 12 bp, synthetic construct
  misc_feature 1..12: note = Description of Artificial Sequence: Synthetic oligonucleotide
  source 1..12: mol_type = other DNA
caatgagggaga

SEQ ID NO: 2629 - DNA, 12 bp, synthetic construct
  misc_feature 1..12: note = Description of Artificial Sequence: Synthetic oligonucleotide
  source 1..12: mol_type = other DNA
gagatcgcctat

SEQ ID NO: 2630 - DNA, 12 bp, synthetic construct
  misc_feature 1..12: note = Description of Artificial Sequence: Synthetic oligonucleotide
  source 1..12: mol_type = other DNA
gaggctgattta

SEQ ID NO: 2631 - DNA, 12 bp, synthetic construct
  misc_feature 1..12: note = Description of Artificial Sequence: Synthetic oligonucleotide
  source 1..12: mol_type = other DNA
ccttaagggcat

SEQ ID NO: 2632 - DNA, 12 bp, synthetic construct
  misc_feature 1..12: note = Description of Artificial Sequence: Synthetic oligonucleotide
  source 1..12: mol_type = other DNA
gtagaatgctcc

SEQ ID NO: 2633 - DNA, 12 bp, synthetic construct
  misc_feature 1..12: note = Description of Artificial Sequence: Synthetic oligonucleotide
  source 1..12: mol_type = other DNA
aagcaacggtgg

SEQ ID NO: 2634 - DNA, 12 bp, synthetic construct
  misc_feature 1..12: note = Description of Artificial Sequence: Synthetic oligonucleotide
  source 1..12: mol_type = other DNA
tgtacatcgccg

SEQ ID NO: 2635 - DNA, 12 bp, synthetic construct
  misc_feature 1..12: note = Description of Artificial Sequence: Synthetic oligonucleotide
  source 1..12: mol_type = other DNA
gagttagcatca

SEQ ID NO: 2636 - DNA, 12 bp, synthetic construct
  misc_feature 1..12: note = Description of Artificial Sequence: Synthetic oligonucleotide
  source 1..12: mol_type = other DNA
gctgctacaagt

SEQ ID NO: 2637 - DNA, 12 bp, synthetic construct
  misc_feature 1..12: note = Description of Artificial Sequence: Synthetic oligonucleotide
  source 1..12: mol_type = other DNA
acaccctatcgg

SEQ ID NO: 2638 - DNA, 12 bp, synthetic construct
  misc_feature 1..12: note = Description of Artificial Sequence: Synthetic oligonucleotide
  source 1..12: mol_type = other DNA
ctccaatgacgc

SEQ ID NO: 2639 - DNA, 12 bp, synthetic construct
  misc_feature 1..12: note = Description of Artificial Sequence: Synthetic oligonucleotide
  source 1..12: mol_type = other DNA
tgttaagcagca

SEQ ID NO: 2640 - DNA, 12 bp, synthetic construct
  misc_feature 1..12: note = Description of Artificial Sequence: Synthetic oligonucleotide
  source 1..12: mol_type = other DNA
tgtagtataggc

SEQ ID NO: 2641 - DNA, 12 bp, synthetic construct
  misc_feature 1..12: note = Description of Artificial Sequence: Synthetic oligonucleotide
  source 1..12: mol_type = other DNA
gtaaacgacttg

SEQ ID NO: 2642 - DNA, 12 bp, synthetic construct
  misc_feature 1..12: note = Description of Artificial Sequence: Synthetic oligonucleotide
  source 1..12: mol_type = other DNA
aggaggataaag

SEQ ID NO: 2643 - DNA, 12 bp, synthetic construct
  misc_feature 1..12: note = Description of Artificial Sequence: Synthetic oligonucleotide
  source 1..12: mol_type = other DNA
atggaaggtggc

SEQ ID NO: 2644 - DNA, 12 bp, synthetic construct
  misc_feature 1..12: note = Description of Artificial Sequence: Synthetic oligonucleotide
  source 1..12: mol_type = other DNA
acggcgttatgt

SEQ ID NO: 2645 - DNA, 12 bp, synthetic construct
  misc_feature 1..12: note = Description of Artificial Sequence: Synthetic oligonucleotide
  source 1..12: mol_type = other DNA
ctcacgcaatgc

SEQ ID NO: 2646 - DNA, 12 bp, synthetic construct
  misc_feature 1..12: note = Description of Artificial Sequence: Synthetic oligonucleotide
  source 1..12: mol_type = other DNA
cgccctcttctt

SEQ ID NO: 2647 - DNA, 12 bp, synthetic construct
  misc_feature 1..12: note = Description of Artificial Sequence: Synthetic oligonucleotide
  source 1..12: mol_type = other DNA
gcatgggttatc

SEQ ID NO: 2648 - DNA, 12 bp, synthetic construct
  misc_feature 1..12: note = Description of Artificial Sequence: Synthetic oligonucleotide
  source 1..12: mol_type = other DNA
ccggcttatgtg

SEQ ID NO: 2649 - DNA, 12 bp, synthetic construct
  misc_feature 1..12: note = Description of Artificial Sequence: Synthetic oligonucleotide
  source 1..12: mol_type = other DNA
actttgctttgc

SEQ ID NO: 2650 - DNA, 12 bp, synthetic construct
  misc_feature 1..12: note = Description of Artificial Sequence: Synthetic oligonucleotide
  source 1..12: mol_type = other DNA
gtcccgtgaaat

SEQ ID NO: 2651 - DNA, 12 bp, synthetic construct
  misc_feature 1..12: note = Description of Artificial Sequence: Synthetic oligonucleotide
  source 1..12: mol_type = other DNA
actagacgacta

SEQ ID NO: 2652 - DNA, 12 bp, synthetic construct
  misc_feature 1..12: note = Description of Artificial Sequence: Synthetic oligonucleotide
  source 1..12: mol_type = other DNA
gttcccaacggt

SEQ ID NO: 2653 - DNA, 12 bp, synthetic construct
  misc_feature 1..12: note = Description of Artificial Sequence: Synthetic oligonucleotide
  source 1..12: mol_type = other DNA
ctgtgcaacgtc

SEQ ID NO: 2654 - DNA, 12 bp, synthetic construct
  misc_feature 1..12: note = Description of Artificial Sequence: Synthetic oligonucleotide
  source 1..12: mol_type = other DNA
caaagcggtatt

SEQ ID NO: 2655 - DNA, 12 bp, synthetic construct
  misc_feature 1..12: note = Description of Artificial Sequence: Synthetic oligonucleotide
  source 1..12: mol_type = other DNA
ggacagtgtatt

SEQ ID NO: 2656 - DNA, 12 bp, synthetic construct
  misc_feature 1..12: note = Description of Artificial Sequence: Synthetic oligonucleotide
  source 1..12: mol_type = other DNA
aggttaagtgct

SEQ ID NO: 2657 - DNA, 12 bp, synthetic construct
  misc_feature 1..12: note = Description of Artificial Sequence: Synthetic oligonucleotide
  source 1..12: mol_type = other DNA
gtcagagtattg

SEQ ID NO: 2658 - DNA, 12 bp, synthetic construct
  misc_feature 1..12: note = Description of Artificial Sequence: Synthetic oligonucleotide
  source 1..12: mol_type = other DNA
agtcaatggcct

SEQ ID NO: 2659 - DNA, 12 bp, synthetic construct
  misc_feature 1..12: note = Description of Artificial Sequence: Synthetic oligonucleotide
  source 1..12: mol_type = other DNA
cgaaactacgta

SEQ ID NO: 2660 - DNA, 12 bp, synthetic construct
  misc_feature 1..12: note = Description of Artificial Sequence: Synthetic oligonucleotide
  source 1..12: mol_type = other DNA
acacgactatag

SEQ ID NO: 2661 - DNA, 12 bp, synthetic construct
  misc_feature 1..12: note = Description of Artificial Sequence: Synthetic oligonucleotide
  source 1..12: mol_type = other DNA
atatcctgggac

SEQ ID NO: 2662 - DNA, 12 bp, synthetic construct
  misc_feature 1..12: note = Description of Artificial Sequence: Synthetic oligonucleotide
  source 1..12: mol_type = other DNA
atgacagaacct

SEQ ID NO: 2663 - DNA, 12 bp, synthetic construct
  misc_feature 1..12: note = Description of Artificial Sequence: Synthetic oligonucleotide
  source 1..12: mol_type = other DNA
ggaacacatgtt

SEQ ID NO: 2664 - DNA, 12 bp, synthetic construct
  misc_feature 1..12: note = Description of Artificial Sequence: Synthetic oligonucleotide
  source 1..12: mol_type = other DNA
gaggaccagcaa

SEQ ID NO: 2665 - DNA, 12 bp, synthetic construct
  misc_feature 1..12: note = Description of Artificial Sequence: Synthetic oligonucleotide
  source 1..12: mol_type = other DNA
gtgtaggtgctt

SEQ ID NO: 2666 - DNA, 12 bp, synthetic construct
  misc_feature 1..12: note = Description of Artificial Sequence: Synthetic oligonucleotide
  source 1..12: mol_type = other DNA
ttgtagccgaca

SEQ ID NO: 2667 - DNA, 12 bp, synthetic construct
  misc_feature 1..12: note = Description of Artificial Sequence: Synthetic oligonucleotide
  source 1..12: mol_type = other DNA
acaagtgctgct

SEQ ID NO: 2668 - DNA, 12 bp, synthetic construct
  misc_feature 1..12: note = Description of Artificial Sequence: Synthetic oligonucleotide
  source 1..12: mol_type = other DNA
agcgcatatcca

SEQ ID NO: 2669 - DNA, 12 bp, synthetic construct
  misc_feature 1..12: note = Description of Artificial Sequence: Synthetic oligonucleotide
  source 1..12: mol_type = other DNA
aatagcatgtcg

SEQ ID NO: 2670 - DNA, 12 bp, synthetic construct
  misc_feature 1..12: note = Description of Artificial Sequence: Synthetic oligonucleotide
  source 1..12: mol_type = other DNA
tgaactagcgtc

SEQ ID NO: 2671 - DNA, 12 bp, synthetic construct
  misc_feature 1..12: note = Description of Artificial Sequence: Synthetic oligonucleotide
  source 1..12: mol_type = other DNA
tcagaagctcaa

SEQ ID NO: 2672 - DNA, 12 bp, synthetic construct
  misc_feature 1..12: note = Description of Artificial Sequence: Synthetic oligonucleotide
  source 1..12: mol_type = other DNA
aatagtcgtgac

SEQ ID NO: 2673 - DNA, 12 bp, synthetic construct
  misc_feature 1..12: note = Description of Artificial Sequence: Synthetic oligonucleotide
  source 1..12: mol_type = other DNA
tgcaacttgcag

SEQ ID NO: 2674 - DNA, 12 bp, synthetic construct
  misc_feature 1..12: note = Description of Artificial Sequence: Synthetic oligonucleotide
  source 1..12: mol_type = other DNA
cggagtaatcct

SEQ ID NO: 2675 - DNA, 12 bp, synthetic construct
  misc_feature 1..12: note = Description of Artificial Sequence: Synthetic oligonucleotide
  source 1..12: mol_type = other DNA
tccgagtcacca

SEQ ID NO: 2676 - DNA, 12 bp, synthetic construct
  misc_feature 1..12: note = Description of Artificial Sequence: Synthetic oligonucleotide
  source 1..12: mol_type = other DNA
actgtgacgtcc

SEQ ID NO: 2677 - DNA, 12 bp, synthetic construct
  misc_feature 1..12: note = Description of Artificial Sequence: Synthetic oligonucleotide
  source 1..12: mol_type = other DNA
tacaagtggtcc

SEQ ID NO: 2678 - DNA, 12 bp, synthetic construct
  misc_feature 1..12: note = Description of Artificial Sequence: Synthetic oligonucleotide
  source 1..12: mol_type = other DNA
gtgtggcagaag

SEQ ID NO: 2679 - DNA, 12 bp, synthetic construct
  misc_feature 1..12: note = Description of Artificial Sequence: Synthetic oligonucleotide
  source 1..12: mol_type = other DNA
ctgtgtccatgg

SEQ ID NO: 2680 - DNA, 12 bp, synthetic construct
  misc_feature 1..12: note = Description of Artificial Sequence: Synthetic oligonucleotide
  source 1..12: mol_type = other DNA
tcctctttggtc

SEQ ID NO: 2681 - DNA, 12 bp, synthetic construct
  misc_feature 1..12: note = Description of Artificial Sequence: Synthetic oligonucleotide
  source 1..12: mol_type = other DNA
ttgcagtgcaac

SEQ ID NO: 2682 - DNA, 12 bp, synthetic construct
  misc_feature 1..12: note = Description of Artificial Sequence: Synthetic oligonucleotide
  source 1..12: mol_type = other DNA
gctggtctagtc

SEQ ID NO: 2683 - DNA, 12 bp, synthetic construct
  misc_feature 1..12: note = Description of Artificial Sequence: Synthetic oligonucleotide
  source 1..12: mol_type = other DNA
gtgaccctgtca

SEQ ID NO: 2684 - DNA, 12 bp, synthetic construct
  misc_feature 1..12: note = Description of Artificial Sequence: Synthetic oligonucleotide
  source 1..12: mol_type = other DNA
cttcgcggatgt

SEQ ID NO: 2685 - DNA, 12 bp, synthetic construct
  misc_feature 1..12: note = Description of Artificial Sequence: Synthetic oligonucleotide
  source 1..12: mol_type = other DNA
tccaccctctat

SEQ ID NO: 2686 - DNA, 12 bp, synthetic construct
  misc_feature 1..12: note = Description of Artificial Sequence: Synthetic oligonucleotide
  source 1..12: mol_type = other DNA
tgtcatggctga

SEQ ID NO: 2687 - DNA, 12 bp, synthetic construct
  misc_feature 1..12: note = Description of Artificial Sequence: Synthetic oligonucleotide
  source 1..12: mol_type = other DNA
ggcatcctggtt

SEQ ID NO: 2688 - DNA, 12 bp, synthetic construct
  misc_feature 1..12: note = Description of Artificial Sequence: Synthetic oligonucleotide
  source 1..12: mol_type = other DNA
cacgcagtctac

SEQ ID NO: 2689 - DNA, 12 bp, synthetic construct
  misc_feature 1..12: note = Description of Artificial Sequence: Synthetic oligonucleotide
  source 1..12: mol_type = other DNA
ataggctgtagt

SEQ ID NO: 2690 - DNA, 12 bp, synthetic construct
  misc_feature 1..12: note = Description of Artificial Sequence: Synthetic oligonucleotide
  source 1..12: mol_type = other DNA
tcgtgacgctaa

SEQ ID NO: 2691 - DNA, 12 bp, synthetic construct
  misc_feature 1..12: note = Description of Artificial Sequence: Synthetic oligonucleotide
  source 1..12: mol_type = other DNA
ttcgtgaggata

SEQ ID NO: 2692 - DNA, 12 bp, synthetic construct
  misc_feature 1..12: note = Description of Artificial Sequence: Synthetic oligonucleotide
  source 1..12: mol_type = other DNA
gtgcctcaggtt

SEQ ID NO: 2693 - DNA, 12 bp, synthetic construct
  misc_feature 1..12: note = Description of Artificial Sequence: Synthetic oligonucleotide
  source 1..12: mol_type = other DNA
ttcactgtgcgg

SEQ ID NO: 2694 - DNA, 12 bp, synthetic construct
  misc_feature 1..12: note = Description of Artificial Sequence: Synthetic oligonucleotide
  source 1..12: mol_type = other DNA
tgtgtagccatg

SEQ ID NO: 2695 - DNA, 12 bp, synthetic construct
  misc_feature 1..12: note = Description of Artificial Sequence: Synthetic oligonucleotide
  source 1..12: mol_type = other DNA
acggctagttcc

SEQ ID NO: 2696 - DNA, 12 bp, synthetic construct
  misc_feature 1..12: note = Description of Artificial Sequence: Synthetic oligonucleotide
  source 1..12: mol_type = other DNA
tcccaacctagg

SEQ ID NO: 2697 - DNA, 12 bp, synthetic construct
  misc_feature 1..12: note = Description of Artificial Sequence: Synthetic oligonucleotide
  source 1..12: mol_type = other DNA
attacagcgaca

SEQ ID NO: 2698 - DNA, 12 bp, synthetic construct
  misc_feature 1..12: note = Description of Artificial Sequence: Synthetic oligonucleotide
  source 1..12: mol_type = other DNA
aacgaataccac

SEQ ID NO: 2699 - DNA, 12 bp, synthetic construct
  misc_feature 1..12: note = Description of Artificial Sequence: Synthetic oligonucleotide
  source 1..12: mol_type = other DNA
aagggcgctgaa

SEQ ID NO: 2700 - DNA, 12 bp, synthetic construct
  misc_feature 1..12: note = Description of Artificial Sequence: Synthetic oligonucleotide
  source 1..12: mol_type = other DNA
gcactggcatat

SEQ ID NO: 2701 - DNA, 12 bp, synthetic construct
  misc_feature 1..12: note = Description of Artificial Sequence: Synthetic oligonucleotide
  source 1..12: mol_type = other DNA
tagaatcaacgc

SEQ ID NO: 2702 - DNA, 12 bp, synthetic construct
  misc_feature 1..12: note = Description of Artificial Sequence: Synthetic oligonucleotide
  source 1..12: mol_type = other DNA
atgcagagatct

SEQ ID NO: 2703 - DNA, 12 bp, synthetic construct
  misc_feature 1..12: note = Description of Artificial Sequence: Synthetic oligonucleotide
  source 1..12: mol_type = other DNA
atggttcacccg

SEQ ID NO: 2704 - DNA, 12 bp, synthetic construct
  misc_feature 1..12: note = Description of Artificial Sequence: Synthetic oligonucleotide
  source 1..12: mol_type = other DNA
gtttccgtggtg

SEQ ID NO: 2705 - DNA, 12 bp, synthetic construct
  misc_feature 1..12: note = Description of Artificial Sequence: Synthetic oligonucleotide
  source 1..12: mol_type = other DNA
ggcattagttga

SEQ ID NO: 2706 - DNA, 12 bp, synthetic construct
  misc_feature 1..12: note = Description of Artificial Sequence: Synthetic oligonucleotide
  source 1..12: mol_type = other DNA
cacaatacaccg

SEQ ID NO: 2707 - DNA, 12 bp, synthetic construct
  misc_feature 1..12: note = Description of Artificial Sequence: Synthetic oligonucleotide
  source 1..12: mol_type = other DNA
cgtatgccgtac

SEQ ID NO: 2708 - DNA, 12 bp, synthetic construct
  misc_feature 1..12: note = Description of Artificial Sequence: Synthetic oligonucleotide
  source 1..12: mol_type = other DNA
tagcggaagacg

SEQ ID NO: 2709 - DNA, 12 bp, synthetic construct
  misc_feature 1..12: note = Description of Artificial Sequence: Synthetic oligonucleotide
  source 1..12: mol_type = other DNA
aggaaccagacg

SEQ ID NO: 2710 - DNA, 12 bp, synthetic construct
  misc_feature 1..12: note = Description of Artificial Sequence: Synthetic oligonucleotide
  source 1..12: mol_type = other DNA
cggtagttgatc

SEQ ID NO: 2711 - DNA, 12 bp, synthetic construct
  misc_feature 1..12: note = Description of Artificial Sequence: Synthetic oligonucleotide
  source 1..12: mol_type = other DNA
gtatgactagca

SEQ ID NO: 2712 - DNA, 12 bp, synthetic construct
  misc_feature 1..12: note = Description of Artificial Sequence: Synthetic oligonucleotide
  source 1..12: mol_type = other DNA
agccgactctgt

SEQ ID NO: 2713 - DNA, 12 bp, synthetic construct
  misc_feature 1..12: note = Description of Artificial Sequence: Synthetic oligonucleotide
  source 1..12: mol_type = other DNA
cctcatgctatt

SEQ ID NO: 2714 - DNA, 12 bp, synthetic construct
  misc_feature 1..12: note = Description of Artificial Sequence: Synthetic oligonucleotide
  source 1..12: mol_type = other DNA
taatgcccaggt

SEQ ID NO: 2715 - DNA, 12 bp, synthetic construct
  misc_feature 1..12: note = Description of Artificial Sequence: Synthetic oligonucleotide
  source 1..12: mol_type = other DNA
tgaaagcggcga

SEQ ID NO: 2716 - DNA, 12 bp, synthetic construct
  misc_feature 1..12: note = Description of Artificial Sequence: Synthetic oligonucleotide
  source 1..12: mol_type = other DNA
atgctctagaga

SEQ ID NO: 2717 - DNA, 12 bp, synthetic construct
  misc_feature 1..12: note = Description of Artificial Sequence: Synthetic oligonucleotide
  source 1..12: mol_type = other DNA
ctattcttggct

SEQ ID NO: 2718 - DNA, 12 bp, synthetic construct
  misc_feature 1..12: note = Description of Artificial Sequence: Synthetic oligonucleotide
  source 1..12: mol_type = other DNA
ccatcttaccat

SEQ ID NO: 2719 - DNA, 12 bp, synthetic construct
  misc_feature 1..12: note = Description of Artificial Sequence: Synthetic oligonucleotide
  source 1..12: mol_type = other DNA
tatgaacgtccg

SEQ ID NO: 2720 - DNA, 12 bp, synthetic construct
  misc_feature 1..12: note = Description of Artificial Sequence: Synthetic oligonucleotide
  source 1..12: mol_type = other DNA
ggttacggttac

SEQ ID NO: 2721 - DNA, 12 bp, synthetic construct
  misc_feature 1..12: note = Description of Artificial Sequence: Synthetic oligonucleotide
  source 1..12: mol_type = other DNA
agctagcgttca

SEQ ID NO: 2722 - DNA, 12 bp, synthetic construct
  misc_feature 1..12: note = Description of Artificial Sequence: Synthetic oligonucleotide
  source 1..12: mol_type = other DNA
tcggtagcaact

SEQ ID NO: 2723 - DNA, 12 bp, synthetic construct
  misc_feature 1..12: note = Description of Artificial Sequence: Synthetic oligonucleotide
  source 1..12: mol_type = other DNA
tatgctctctca

SEQ ID NO: 2724 - DNA, 12 bp, synthetic construct
  misc_feature 1..12: note = Description of Artificial Sequence: Synthetic oligonucleotide
  source 1..12: mol_type = other DNA
ccacattgggtc

SEQ ID NO: 2725 - DNA, 12 bp, synthetic construct
  misc_feature 1..12: note = Description of Artificial Sequence: Synthetic oligonucleotide
  source 1..12: mol_type = other DNA
acatcaggtcac

SEQ ID NO: 2726 - DNA, 12 bp, synthetic construct
  misc_feature 1..12: note = Description of Artificial Sequence: Synthetic oligonucleotide
  source 1..12: mol_type = other DNA
ggtcttagcacc

SEQ ID NO: 2727 - DNA, 12 bp, synthetic construct
  misc_feature 1..12: note = Description of Artificial Sequence: Synthetic oligonucleotide
  source 1..12: mol_type = other DNA
ccaaatgatgac

SEQ ID NO: 2728 - DNA, 12 bp, synthetic construct
  misc_feature 1..12: note = Description of Artificial Sequence: Synthetic oligonucleotide
  source 1..12: mol_type = other DNA
cgtgtagtagat

SEQ ID NO: 2729 - DNA, 12 bp, synthetic construct
  misc_feature 1..12: note = Description of Artificial Sequence: Synthetic oligonucleotide
  source 1..12: mol_type = other DNA
tcagtcagatga

SEQ ID NO: 2730 - DNA, 12 bp, synthetic construct
  misc_feature 1..12: note = Description of Artificial Sequence: Synthetic oligonucleotide
  source 1..12: mol_type = other DNA
gttgatacgatg

SEQ ID NO: 2731 - DNA, 12 bp, synthetic construct
  misc_feature 1..12: note = Description of Artificial Sequence: Synthetic oligonucleotide
  source 1..12: mol_type = other DNA
taccatccatct

SEQ ID NO: 2732 - DNA, 12 bp, synthetic construct
  misc_feature 1..12: note = Description of Artificial Sequence: Synthetic oligonucleotide
  source 1..12: mol_type = other DNA
gcaggtaacatt

SEQ ID NO: 2733 - DNA, 12 bp, synthetic construct
  misc_feature 1..12: note = Description of Artificial Sequence: Synthetic oligonucleotide
  source 1..12: mol_type = other DNA
acatgggcggaa

SEQ ID NO: 2734 - DNA, 12 bp, synthetic construct
  misc_feature 1..12: note = Description of Artificial Sequence: Synthetic oligonucleotide
  source 1..12: mol_type = other DNA
aagtcacacaca

SEQ ID NO: 2735 - DNA, 12 bp, synthetic construct
  misc_feature 1..12: note = Description of Artificial Sequence: Synthetic oligonucleotide
  source 1..12: mol_type = other DNA
cagacacttccg

SEQ ID NO: 2736 - DNA, 12 bp, synthetic construct
  misc_feature 1..12: note = Description of Artificial Sequence: Synthetic oligonucleotide
  source 1..12: mol_type = other DNA
agggatggacca

SEQ ID NO: 2737 - DNA, 12 bp, synthetic construct
  misc_feature 1..12: note = Description of Artificial Sequence: Synthetic oligonucleotide
  source 1..12: mol_type = other DNA
gcacgttctacg

SEQ ID NO: 2738 - DNA, 12 bp, synthetic construct
  misc_feature 1..12: note = Description of Artificial Sequence: Synthetic oligonucleotide
  source 1..12: mol_type = other DNA
ccgctgatgtca

SEQ ID NO: 2739 - DNA, 12 bp, synthetic construct
  misc_feature 1..12: note = Description of Artificial Sequence: Synthetic oligonucleotide
  source 1..12: mol_type = other DNA
gctgtgattcga

SEQ ID NO: 2740 - DNA, 12 bp, synthetic construct
  misc_feature 1..12: note = Description of Artificial Sequence: Synthetic oligonucleotide
  source 1..12: mol_type = other DNA
tcaccatccgag

SEQ ID NO: 2741 - DNA, 12 bp, synthetic construct
  misc_feature 1..12: note = Description of Artificial Sequence: Synthetic oligonucleotide
  source 1..12: mol_type = other DNA
actaatacgcga

SEQ ID NO: 2742 - DNA, 12 bp, synthetic construct
  misc_feature 1..12: note = Description of Artificial Sequence: Synthetic oligonucleotide
  source 1..12: mol_type = other DNA
gactggagatgg

SEQ ID NO: 2743 - DNA, 12 bp, synthetic construct
  misc_feature 1..12: note = Description of Artificial Sequence: Synthetic oligonucleotide
  source 1..12: mol_type = other DNA
acgagtttaccg

SEQ ID NO: 2744 - DNA, 12 bp, synthetic construct
  misc_feature 1..12: note = Description of Artificial Sequence: Synthetic oligonucleotide
  source 1..12: mol_type = other DNA
ctagctatggac

SEQ ID NO: 2745 - DNA, 12 bp, synthetic construct
  misc_feature 1..12: note = Description of Artificial Sequence: Synthetic oligonucleotide
  source 1..12: mol_type = other DNA
acccaccactag

SEQ ID NO: 2746 - DNA, 12 bp, synthetic construct
  misc_feature 1..12: note = Description of Artificial Sequence: Synthetic oligonucleotide
  source 1..12: mol_type = other DNA
tcatacagccag

SEQ ID NO: 2747 - DNA, 12 bp, synthetic construct
  misc_feature 1..12: note = Description of Artificial Sequence: Synthetic oligonucleotide
  source 1..12: mol_type = other DNA
actaagtacccg

SEQ ID NO: 2748 - DNA, 12 bp, synthetic construct
  misc_feature 1..12: note = Description of Artificial Sequence: Synthetic oligonucleotide
  source 1..12: mol_type = other DNA
ggagattggaga

SEQ ID NO: 2749 - DNA, 12 bp, synthetic construct
  misc_feature 1..12: note = Description of Artificial Sequence: Synthetic oligonucleotide
  source 1..12: mol_type = other DNA
cttgacgaggtt

SEQ ID NO: 2750 - DNA, 12 bp, synthetic construct
  misc_feature 1..12: note = Description of Artificial Sequence: Synthetic oligonucleotide
  source 1..12: mol_type = other DNA
cagaaggtgtgg

SEQ ID NO: 2751 - DNA, 12 bp, synthetic construct
  misc_feature 1..12: note = Description of Artificial Sequence: Synthetic oligonucleotide
  source 1..12: mol_type = other DNA
ggaggccataag

SEQ ID NO: 2752 - DNA, 12 bp, synthetic construct
  misc_feature 1..12: note = Description of Artificial Sequence: Synthetic oligonucleotide
  source 1..12: mol_type = other DNA
taagtgagtacc

SEQ ID NO: 2753 - DNA, 12 bp, synthetic construct
  misc_feature 1..12: note = Description of Artificial Sequence: Synthetic oligonucleotide
  source 1..12: mol_type = other DNA
aagcccagcatt

SEQ ID NO: 2754 - DNA, 12 bp, synthetic construct
  misc_feature 1..12: note = Description of Artificial Sequence: Synthetic oligonucleotide
  source 1..12: mol_type = other DNA
acctgggaatat

SEQ ID NO: 2755 - DNA, 12 bp, synthetic construct
  misc_feature 1..12: note = Description of Artificial Sequence: Synthetic oligonucleotide
  source 1..12: mol_type = other DNA
gaagcttgaatc

SEQ ID NO: 2756 - DNA, 12 bp, synthetic construct
  misc_feature 1..12: note = Description of Artificial Sequence: Synthetic oligonucleotide
  source 1..12: mol_type = other DNA
gtccgatcctag

SEQ ID NO: 2757 - DNA, 12 bp, synthetic construct
  misc_feature 1..12: note = Description of Artificial Sequence: Synthetic oligonucleotide
  source 1..12: mol_type = other DNA
atcgacaacacc

SEQ ID NO: 2758 - DNA, 12 bp, synthetic construct
  misc_feature 1..12: note = Description of Artificial Sequence: Synthetic oligonucleotide
  source 1..12: mol_type = other DNA
ggtgaaacctat

SEQ ID NO: 2759 - DNA, 12 bp, synthetic construct
  misc_feature 1..12: note = Description of Artificial Sequence: Synthetic oligonucleotide
  source 1..12: mol_type = other DNA
ctctgcctaatt

SEQ ID NO: 2760 - DNA, 12 bp, synthetic construct
  misc_feature 1..12: note = Description of Artificial Sequence: Synthetic oligonucleotide
  source 1..12: mol_type = other DNA
actaggatcagt

SEQ ID NO: 2761 - DNA, 12 bp, synthetic construct
  misc_feature 1..12: note = Description of Artificial Sequence: Synthetic oligonucleotide
  source 1..12: mol_type = other DNA
ctgtgggattca

SEQ ID NO: 2762 - DNA, 12 bp, synthetic construct
  misc_feature 1..12: note = Description of Artificial Sequence: Synthetic oligonucleotide
  source 1..12: mol_type = other DNA
agcacactacac

SEQ ID NO: 2763 - DNA, 12 bp, synthetic construct
  misc_feature 1..12: note = Description of Artificial Sequence: Synthetic oligonucleotide
  source 1..12: mol_type = other DNA
tggtaagagtct

SEQ ID NO: 2764 - DNA, 12 bp, synthetic construct
  misc_feature 1..12: note = Description of Artificial Sequence: Synthetic oligonucleotide
  source 1..12: mol_type = other DNA
atatgacccagc

SEQ ID NO: 2765 - DNA, 12 bp, synthetic construct
  misc_feature 1..12: note = Description of Artificial Sequence: Synthetic oligonucleotide
  source 1..12: mol_type = other DNA
gctccttagaag

SEQ ID NO: 2766 - DNA, 12 bp, synthetic construct
  misc_feature 1..12: note = Description of Artificial Sequence: Synthetic oligonucleotide
  source 1..12: mol_type = other DNA
ttgtctacctac

SEQ ID NO: 2767 - DNA, 12 bp, synthetic construct
  misc_feature 1..12: note = Description of Artificial Sequence: Synthetic oligonucleotide
  source 1..12: mol_type = other DNA
gaatgttgcgct

SEQ ID NO: 2768 - DNA, 12 bp, synthetic construct
  misc_feature 1..12: note = Description of Artificial Sequence: Synthetic oligonucleotide
  source 1..12: mol_type = other DNA
gcgcttagaata

SEQ ID NO: 2769 - DNA, 12 bp, synthetic construct
  misc_feature 1..12: note = Description of Artificial Sequence: Synthetic oligonucleotide
  source 1..12: mol_type = other DNA
ctctattccacc

SEQ ID NO: 2770 - DNA, 12 bp, synthetic construct
  misc_feature 1..12: note = Description of Artificial Sequence: Synthetic oligonucleotide
  source 1..12: mol_type = other DNA
tcccattcccat

SEQ ID NO: 2771 - DNA, 12 bp, synthetic construct
  misc_feature 1..12: note = Description of Artificial Sequence: Synthetic oligonucleotide
  source 1..12: mol_type = other DNA
gaaggctcctta

SEQ ID NO: 2772 - DNA, 12 bp, synthetic construct
  misc_feature 1..12: note = Description of Artificial Sequence: Synthetic oligonucleotide
  source 1..12: mol_type = other DNA
cgcgcaagtatt

SEQ ID NO: 2773 - DNA, 12 bp, synthetic construct
  misc_feature 1..12: note = Description of Artificial Sequence: Synthetic oligonucleotide
  source 1..12: mol_type = other DNA
aggtgtatcacc

SEQ ID NO: 2774 - DNA, 12 bp, synthetic construct
  misc_feature 1..12: note = Description of Artificial Sequence: Synthetic oligonucleotide
  source 1..12: mol_type = other DNA
attgagtgagtc

SEQ ID NO: 2775 - DNA, 12 bp, synthetic construct
  misc_feature 1..12: note = Description of Artificial Sequence: Synthetic oligonucleotide
  source 1..12: mol_type = other DNA
tggcgtcattcg

SEQ ID NO: 2776 - DNA, 12 bp, synthetic construct
  misc_feature 1..12: note = Description of Artificial Sequence: Synthetic oligonucleotide
  source 1..12: mol_type = other DNA
agattacaaccg

SEQ ID NO: 2777 - DNA, 12 bp, synthetic construct
  misc_feature 1..12: note = Description of Artificial Sequence: Synthetic oligonucleotide
  source 1..12: mol_type = other DNA
atagttagggct

SEQ ID NO: 2778 - DNA, 12 bp, synthetic construct
  misc_feature 1..12: note = Description of Artificial Sequence: Synthetic oligonucleotide
  source 1..12: mol_type = other DNA
attgtcaagcag

SEQ ID NO: 2779 - DNA, 12 bp, synthetic construct
  misc_feature 1..12: note = Description of Artificial Sequence: Synthetic oligonucleotide
  source 1..12: mol_type = other DNA
ttatggtacgga

SEQ ID NO: 2780 - DNA, 12 bp, synthetic construct
  misc_feature 1..12: note = Description of Artificial Sequence: Synthetic oligonucleotide
  source 1..12: mol_type = other DNA
aatcctcggagt

SEQ ID NO: 2781 - DNA, 12 bp, synthetic construct
  misc_feature 1..12: note = Description of Artificial Sequence: Synthetic oligonucleotide
  source 1..12: mol_type = other DNA
tcttctgcccta

SEQ ID NO: 2782 - DNA, 12 bp, synthetic construct
  misc_feature 1..12: note = Description of Artificial Sequence: Synthetic oligonucleotide
  source 1..12: mol_type = other DNA
gttcaacagctg

SEQ ID NO: 2783 - DNA, 12 bp, synthetic construct
  misc_feature 1..12: note = Description of Artificial Sequence: Synthetic oligonucleotide
  source 1..12: mol_type = other DNA
ttcgcagatacg

SEQ ID NO: 2784 - DNA, 12 bp, synthetic construct
  misc_feature 1..12: note = Description of Artificial Sequence: Synthetic oligonucleotide
  source 1..12: mol_type = other DNA
gctagttatgga

SEQ ID NO: 2785 - DNA, 12 bp, synthetic construct
  misc_feature 1..12: note = Description of Artificial Sequence: Synthetic oligonucleotide
  source 1..12: mol_type = other DNA
ctggacgcatta

SEQ ID NO: 2786 - DNA, 12 bp, synthetic construct
  misc_feature 1..12: note = Description of Artificial Sequence: Synthetic oligonucleotide
  source 1..12: mol_type = other DNA
tgaagtcacagt

SEQ ID NO: 2787 - DNA, 12 bp, synthetic construct
  misc_feature 1..12: note = Description of Artificial Sequence: Synthetic oligonucleotide
  source 1..12: mol_type = other DNA
tcagcaaatggt

SEQ ID NO: 2788 - DNA, 12 bp, synthetic construct
  misc_feature 1..12: note = Description of Artificial Sequence: Synthetic oligonucleotide
  source 1..12: mol_type = other DNA
cataggccatca

SEQ ID NO: 2789 - DNA, 12 bp, synthetic construct
  misc_feature 1..12: note = Description of Artificial Sequence: Synthetic oligonucleotide
  source 1..12: mol_type = other DNA
cagattaaccag

SEQ ID NO: 2790 - DNA, 12 bp, synthetic construct
  misc_feature 1..12: note = Description of Artificial Sequence: Synthetic oligonucleotide
  source 1..12: mol_type = other DNA
accgattaggta

SEQ ID NO: 2791 - DNA, 12 bp, synthetic construct
  misc_feature 1..12: note = Description of Artificial Sequence: Synthetic oligonucleotide
  source 1..12: mol_type = other DNA
cttagtgcagaa

SEQ ID NO: 2792 - DNA, 12 bp, synthetic construct
  misc_feature 1..12: note = Description of Artificial Sequence: Synthetic oligonucleotide
  source 1..12: mol_type = other DNA
agggacttcaat

SEQ ID NO: 2793 - DNA, 12 bp, synthetic construct
  misc_feature 1..12: note = Description of Artificial Sequence: Synthetic oligonucleotide
  source 1..12: mol_type = other DNA
ccttggaatcgc

SEQ ID NO: 2794 - DNA, 12 bp, synthetic construct
  misc_feature 1..12: note = Description of Artificial Sequence: Synthetic oligonucleotide
  source 1..12: mol_type = other DNA
ggctgcatactc

SEQ ID NO: 2795 - DNA, 12 bp, synthetic construct
  misc_feature 1..12: note = Description of Artificial Sequence: Synthetic oligonucleotide
  source 1..12: mol_type = other DNA
atgtgctgctcg

SEQ ID NO: 2796 - DNA, 12 bp, synthetic construct
  misc_feature 1..12: note = Description of Artificial Sequence: Synthetic oligonucleotide
  source 1..12: mol_type = other DNA
catcagtacgcc

SEQ ID NO: 2797 - DNA, 12 bp, synthetic construct
  misc_feature 1..12: note = Description of Artificial Sequence: Synthetic oligonucleotide
  source 1..12: mol_type = other DNA
gaagtgtatctg

SEQ ID NO: 2798 - DNA, 12 bp, synthetic construct
  misc_feature 1..12: note = Description of Artificial Sequence: Synthetic oligonucleotide
  source 1..12: mol_type = other DNA
cacttgctctct

SEQ ID NO: 2799 - DNA, 12 bp, synthetic construct
  misc_feature 1..12: note = Description of Artificial Sequence: Synthetic oligonucleotide
  source 1..12: mol_type = other DNA
ttggtaaagtgc

SEQ ID NO: 2800 - DNA, 12 bp, synthetic construct
  misc_feature 1..12: note = Description of Artificial Sequence: Synthetic oligonucleotide
  source 1..12: mol_type = other DNA
tacgtacgaaac

SEQ ID NO: 2801 - DNA, 12 bp, synthetic construct
  misc_feature 1..12: note = Description of Artificial Sequence: Synthetic oligonucleotide
  source 1..12: mol_type = other DNA
tagaacaccatg

SEQ ID NO: 2802 - DNA, 12 bp, synthetic construct
  misc_feature 1..12: note = Description of Artificial Sequence: Synthetic oligonucleotide
  source 1..12: mol_type = other DNA
tcctgtgcgagt

SEQ ID NO: 2803 - DNA, 12 bp, synthetic construct
  misc_feature 1..12: note = Description of Artificial Sequence: Synthetic oligonucleotide
  source 1..12: mol_type = other DNA
gcaacttcggta

SEQ ID NO: 2804 - DNA, 12 bp, synthetic construct
  misc_feature 1..12: note = Description of Artificial Sequence: Synthetic oligonucleotide
  source 1..12: mol_type = other DNA
aagtggctatcc

SEQ ID NO: 2805 - DNA, 12 bp, synthetic construct
  misc_feature 1..12: note = Description of Artificial Sequence: Synthetic oligonucleotide
  source 1..12: mol_type = other DNA
atcacattctcc

SEQ ID NO: 2806 - DNA, 12 bp, synthetic construct
  misc_feature 1..12: note = Description of Artificial Sequence: Synthetic oligonucleotide
  source 1..12: mol_type = other DNA
ccgcatgaccta

SEQ ID NO: 2807 - DNA, 12 bp, synthetic construct
  misc_feature 1..12: note = Description of Artificial Sequence: Synthetic oligonucleotide
  source 1..12: mol_type = other DNA
ccaacgtaacca

SEQ ID NO: 2808 - DNA, 12 bp, synthetic construct
  misc_feature 1..12: note = Description of Artificial Sequence: Synthetic oligonucleotide
  source 1..12: mol_type = other DNA
gccaatccaaca

SEQ ID NO: 2809 - DNA, 12 bp, synthetic construct
  misc_feature 1..12: note = Description of Artificial Sequence: Synthetic oligonucleotide
  source 1..12: mol_type = other DNA
aaccgatgtacc

SEQ ID NO: 2810 - DNA, 12 bp, synthetic construct
  misc_feature 1..12: note = Description of Artificial Sequence: Synthetic oligonucleotide
  source 1..12: mol_type = other DNA
agcctggtacct

SEQ ID NO: 2811 - DNA, 12 bp, synthetic construct
  misc_feature 1..12: note = Description of Artificial Sequence: Synthetic oligonucleotide
  source 1..12: mol_type = other DNA
gagaatggaaag

SEQ ID NO: 2812 - DNA, 12 bp, synthetic construct
  misc_feature 1..12: note = Description of Artificial Sequence: Synthetic oligonucleotide
  source 1..12: mol_type = other DNA
aaggtggacaag

SEQ ID NO: 2813 - DNA, 12 bp, synthetic construct
  misc_feature 1..12: note = Description of Artificial Sequence: Synthetic oligonucleotide
  source 1..12: mol_type = other DNA
ctggaacattag

SEQ ID NO: 2814 - DNA, 12 bp, synthetic construct
  misc_feature 1..12: note = Description of Artificial Sequence: Synthetic oligonucleotide
  source 1..12: mol_type = other DNA
tcgattggccgt

SEQ ID NO: 2815 - DNA, 12 bp, synthetic construct
  misc_feature 1..12: note = Description of Artificial Sequence: Synthetic oligonucleotide
  source 1..12: mol_type = other DNA
gctaaagtcgta

SEQ ID NO: 2816 - DNA, 12 bp, synthetic construct
  misc_feature 1..12: note = Description of Artificial Sequence: Synthetic oligonucleotide
  source 1..12: mol_type = other DNA
aaccctaactgg

SEQ ID NO: 2817 - DNA, 12 bp, synthetic construct
  misc_feature 1..12: note = Description of Artificial Sequence: Synthetic oligonucleotide
  source 1..12: mol_type = other DNA
caattgcgtgca

SEQ ID NO: 2818 - DNA, 12 bp, synthetic construct
  misc_feature 1..12: note = Description of Artificial Sequence: Synthetic oligonucleotide
  source 1..12: mol_type = other DNA
ttagcccagcgt

SEQ ID NO: 2819 - DNA, 12 bp, synthetic construct
  misc_feature 1..12: note = Description of Artificial Sequence: Synthetic oligonucleotide
  source 1..12: mol_type = other DNA
gcattactggac

SEQ ID NO: 2820 - DNA, 12 bp, synthetic construct
  misc_feature 1..12: note = Description of Artificial Sequence: Synthetic oligonucleotide
  source 1..12: mol_type = other DNA
tctcagcgcgta

SEQ ID NO: 2821 - DNA, 12 bp, synthetic construct
  misc_feature 1..12: note = Description of Artificial Sequence: Synthetic oligonucleotide
  source 1..12: mol_type = other DNA
tccataccggaa

SEQ ID NO: 2822 - DNA, 12 bp, synthetic construct
  misc_feature 1..12: note = Description of Artificial Sequence: Synthetic oligonucleotide
  source 1..12: mol_type = other DNA
accagctcagat

SEQ ID NO: 2823 - DNA, 12 bp, synthetic construct
  misc_feature 1..12: note = Description of Artificial Sequence: Synthetic oligonucleotide
  source 1..12: mol_type = other DNA
aatggttcagca

SEQ ID NO: 2824 - DNA, 12 bp, synthetic construct
  misc_feature 1..12: note = Description of Artificial Sequence: Synthetic oligonucleotide
  source 1..12: mol_type = other DNA
ttgggccacata

SEQ ID NO: 2825 - DNA, 12 bp, synthetic construct
  misc_feature 1..12: note = Description of Artificial Sequence: Synthetic oligonucleotide
  source 1..12: mol_type = other DNA
gaccctagacct

SEQ ID NO: 2826 - DNA, 12 bp, synthetic construct
  misc_feature 1..12: note = Description of Artificial Sequence: Synthetic oligonucleotide
  source 1..12: mol_type = other DNA
gttcagactagc

SEQ ID NO: 2827 - DNA, 12 bp, synthetic construct
  misc_feature 1..12: note = Description of Artificial Sequence: Synthetic oligonucleotide
  source 1..12: mol_type = other DNA
acggtaccctac

SEQ ID NO: 2828 - DNA, 12 bp, synthetic construct
  misc_feature 1..12: note = Description of Artificial Sequence: Synthetic oligonucleotide
  source 1..12: mol_type = other DNA
cagcaagaggac

SEQ ID NO: 2829 - DNA, 12 bp, synthetic construct
  misc_feature 1..12: note = Description of Artificial Sequence: Synthetic oligonucleotide
  source 1..12: mol_type = other DNA
cacacaaagtca

SEQ ID NO: 2830 - DNA, 12 bp, synthetic construct
  misc_feature 1..12: note = Description of Artificial Sequence: Synthetic oligonucleotide
  source 1..12: mol_type = other DNA
tattcagcggac

SEQ ID NO: 2831 - DNA, 12 bp, synthetic construct
  misc_feature 1..12: note = Description of Artificial Sequence: Synthetic oligonucleotide
  source 1..12: mol_type = other DNA
gacaccacaata

SEQ ID NO: 2832 - DNA, 12 bp, synthetic construct
  misc_feature 1..12: note = Description of Artificial Sequence: Synthetic oligonucleotide
  source 1..12: mol_type = other DNA
tcatagggtagt

SEQ ID NO: 2833 - DNA, 12 bp, synthetic construct
  misc_feature 1..12: note = Description of Artificial Sequence: Synthetic oligonucleotide
  source 1..12: mol_type = other DNA
ctagtacaagcc

SEQ ID NO: 2834 - DNA, 12 bp, synthetic construct
  misc_feature 1..12: note = Description of Artificial Sequence: Synthetic oligonucleotide
  source 1..12: mol_type = other DNA
gccaaggatagg

SEQ ID NO: 2835 - DNA, 12 bp, synthetic construct
  misc_feature 1..12: note = Description of Artificial Sequence: Synthetic oligonucleotide
  source 1..12: mol_type = other DNA
gttccggattag

SEQ ID NO: 2836 - DNA, 12 bp, synthetic construct
  misc_feature 1..12: note = Description of Artificial Sequence: Synthetic oligonucleotide
  source 1..12: mol_type = other DNA
cgatttaggcca

SEQ ID NO: 2837 - DNA, 12 bp, synthetic construct
  misc_feature 1..12: note = Description of Artificial Sequence: Synthetic oligonucleotide
  source 1..12: mol_type = other DNA
atggagttgttg

SEQ ID NO: 2838 - DNA, 12 bp, synthetic construct
  misc_feature 1..12: note = Description of Artificial Sequence: Synthetic oligonucleotide
  source 1..12: mol_type = other DNA
agagcggaacaa

SEQ ID NO: 2839 - DNA, 12 bp, synthetic construct
  misc_feature 1..12: note = Description of Artificial Sequence: Synthetic oligonucleotide
  source 1..12: mol_type = other DNA
cgccacgtgtat

SEQ ID NO: 2840 - DNA, 12 bp, synthetic construct
  misc_feature 1..12: note = Description of Artificial Sequence: Synthetic oligonucleotide
  source 1..12: mol_type = other DNA
gcgtgtaattag

SEQ ID NO: 2841 - DNA, 12 bp, synthetic construct
  misc_feature 1..12: note = Description of Artificial Sequence: Synthetic oligonucleotide
  source 1..12: mol_type = other DNA
aggatattcgtg

SEQ ID NO: 2842 - DNA, 12 bp, synthetic construct
  misc_feature 1..12: note = Description of Artificial Sequence: Synthetic oligonucleotide
  source 1..12: mol_type = other DNA
cgtatctcagga

SEQ ID NO: 2843 - DNA, 12 bp, synthetic construct
  misc_feature 1..12: note = Description of Artificial Sequence: Synthetic oligonucleotide
  source 1..12: mol_type = other DNA
gcagttgcctca

SEQ ID NO: 2844 - DNA, 12 bp, synthetic construct
  misc_feature 1..12: note = Description of Artificial Sequence: Synthetic oligonucleotide
  source 1..12: mol_type = other DNA
gcaaccgattgt

SEQ ID NO: 2845 - DNA, 12 bp, synthetic construct
  misc_feature 1..12: note = Description of Artificial Sequence: Synthetic oligonucleotide
  source 1..12: mol_type = other DNA
ctgtagcttggc

SEQ ID NO: 2846 - DNA, 12 bp, synthetic construct
  misc_feature 1..12: note = Description of Artificial Sequence: Synthetic oligonucleotide
  source 1..12: mol_type = other DNA
caatacgaccgt

SEQ ID NO: 2847 - DNA, 12 bp, synthetic construct
  misc_feature 1..12: note = Description of Artificial Sequence: Synthetic oligonucleotide
  source 1..12: mol_type = other DNA
tagttcggtgac

SEQ ID NO: 2848 - DNA, 12 bp, synthetic construct
  misc_feature 1..12: note = Description of Artificial Sequence: Synthetic oligonucleotide
  source 1..12: mol_type = other DNA
cgcgccttaaac

SEQ ID NO: 2849 - DNA, 12 bp, synthetic construct
  misc_feature 1..12: note = Description of Artificial Sequence: Synthetic oligonucleotide
  source 1..12: mol_type = other DNA
catgtgcttagg

SEQ ID NO: 2850 - DNA, 12 bp, synthetic construct
  misc_feature 1..12: note = Description of Artificial Sequence: Synthetic oligonucleotide
  source 1..12: mol_type = other DNA
atgcctcgtaag

SEQ ID NO: 2851 - DNA, 12 bp, synthetic construct
  misc_feature 1..12: note = Description of Artificial Sequence: Synthetic oligonucleotide
  source 1..12: mol_type = other DNA
gccatgtgtgta

SEQ ID NO: 2852 - DNA, 12 bp, synthetic construct
  misc_feature 1..12: note = Description of Artificial Sequence: Synthetic oligonucleotide
  source 1..12: mol_type = other DNA
ccatggctgtgt

SEQ ID NO: 2853 - DNA, 12 bp, synthetic construct
  misc_feature 1..12: note = Description of Artificial Sequence: Synthetic oligonucleotide
  source 1..12: mol_type = other DNA
tccgcgcaagtt

SEQ ID NO: 2854 - DNA, 12 bp, synthetic construct
  misc_feature 1..12: note = Description of Artificial Sequence: Synthetic oligonucleotide
  source 1..12: mol_type = other DNA
gttcctccatta

SEQ ID NO: 2855 - DNA, 12 bp, synthetic construct
  misc_feature 1..12: note = Description of Artificial Sequence: Synthetic oligonucleotide
  source 1..12: mol_type = other DNA
acctatggtgaa

SEQ ID NO: 2856 - DNA, 12 bp, synthetic construct
  misc_feature 1..12: note = Description of Artificial Sequence: Synthetic oligonucleotide
  source 1..12: mol_type = other DNA
gactcctagacc

SEQ ID NO: 2857 - DNA, 12 bp, synthetic construct
  misc_feature 1..12: note = Description of Artificial Sequence: Synthetic oligonucleotide
  source 1..12: mol_type = other DNA
ctagtcgctggt

SEQ ID NO: 2858 - DNA, 12 bp, synthetic construct
  misc_feature 1..12: note = Description of Artificial Sequence: Synthetic oligonucleotide
  source 1..12: mol_type = other DNA
taaccaccaacg

SEQ ID NO: 2859 - DNA, 12 bp, synthetic construct
  misc_feature 1..12: note = Description of Artificial Sequence: Synthetic oligonucleotide
  source 1..12: mol_type = other DNA
acctgtcctttc

SEQ ID NO: 2860 - DNA, 12 bp, synthetic construct
  misc_feature 1..12: note = Description of Artificial Sequence: Synthetic oligonucleotide
  source 1..12: mol_type = other DNA
ctgttacagcga

SEQ ID NO: 2861 - DNA, 12 bp, synthetic construct
  misc_feature 1..12: note = Description of Artificial Sequence: Synthetic oligonucleotide
  source 1..12: mol_type = other DNA
aaggcaagaaga

SEQ ID NO: 2862 - DNA, 12 bp, synthetic construct
  misc_feature 1..12: note = Description of Artificial Sequence: Synthetic oligonucleotide
  source 1..12: mol_type = other DNA
tccaagcgtcac

SEQ ID NO: 2863 - DNA, 12 bp, synthetic construct
  misc_feature 1..12: note = Description of Artificial Sequence: Synthetic oligonucleotide
  source 1..12: mol_type = other DNA
tgcgtcagctac

SEQ ID NO: 2864 - DNA, 12 bp, synthetic construct
  misc_feature 1..12: note = Description of Artificial Sequence: Synthetic oligonucleotide
  source 1..12: mol_type = other DNA
gttcacgcccaa

SEQ ID NO: 2865 - DNA, 12 bp, synthetic construct
  misc_feature 1..12: note = Description of Artificial Sequence: Synthetic oligonucleotide
  source 1..12: mol_type = other DNA
cagtcaggcctt

SEQ ID NO: 2866 - DNA, 12 bp, synthetic construct
  misc_feature 1..12: note = Description of Artificial Sequence: Synthetic oligonucleotide
  source 1..12: mol_type = other DNA
acgaggagtcga

SEQ ID NO: 2867 - DNA, 12 bp, synthetic construct
  misc_feature 1..12: note = Description of Artificial Sequence: Synthetic oligonucleotide
  source 1..12: mol_type = other DNA
gcttcatttctg

SEQ ID NO: 2868 - DNA, 12 bp, synthetic construct
  misc_feature 1..12: note = Description of Artificial Sequence: Synthetic oligonucleotide
  source 1..12: mol_type = other DNA
cgaaatgcatgt

SEQ ID NO: 2869 - DNA, 12 bp, synthetic construct
  misc_feature 1..12: note = Description of Artificial Sequence: Synthetic oligonucleotide
  source 1..12: mol_type = other DNA
cgatcgaacact

SEQ ID NO: 2870 - DNA, 12 bp, synthetic construct
  misc_feature 1..12: note = Description of Artificial Sequence: Synthetic oligonucleotide
  source 1..12: mol_type = other DNA
actgagctgcat

SEQ ID NO: 2871 - DNA, 12 bp, synthetic construct
  misc_feature 1..12: note = Description of Artificial Sequence: Synthetic oligonucleotide
  source 1..12: mol_type = other DNA
gcggtactacta

SEQ ID NO: 2872 - DNA, 12 bp, synthetic construct
  misc_feature 1..12: note = Description of Artificial Sequence: Synthetic oligonucleotide
  source 1..12: mol_type = other DNA
aacttggccgta

SEQ ID NO: 2873 - DNA, 12 bp, synthetic construct
  misc_feature 1..12: note = Description of Artificial Sequence: Synthetic oligonucleotide
  source 1..12: mol_type = other DNA
atgatcggtaca

SEQ ID NO: 2874 - DNA, 12 bp, synthetic construct
  misc_feature 1..12: note = Description of Artificial Sequence: Synthetic oligonucleotide
  source 1..12: mol_type = other DNA
catgccaacatg

SEQ ID NO: 2875 - DNA, 12 bp, synthetic construct
  misc_feature 1..12: note = Description of Artificial Sequence: Synthetic oligonucleotide
  source 1..12: mol_type = other DNA
acgaagtctacc

SEQ ID NO: 2876 - DNA, 12 bp, synthetic construct
  misc_feature 1..12: note = Description of Artificial Sequence: Synthetic oligonucleotide
  source 1..12: mol_type = other DNA
tcagctgactag

SEQ ID NO: 2877 - DNA, 12 bp, synthetic construct
  misc_feature 1..12: note = Description of Artificial Sequence: Synthetic oligonucleotide
  source 1..12: mol_type = other DNA
catacgatacag

SEQ ID NO: 2878 - DNA, 12 bp, synthetic construct
  misc_feature 1..12: note = Description of Artificial Sequence: Synthetic oligonucleotide
  source 1..12: mol_type = other DNA
ttacccgcacag

SEQ ID NO: 2879 - DNA, 12 bp, synthetic construct
  misc_feature 1..12: note = Description of Artificial Sequence: Synthetic oligonucleotide
  source 1..12: mol_type = other DNA
gagtacagtcta

SEQ ID NO: 2880 - DNA, 12 bp, synthetic construct
  misc_feature 1..12: note = Description of Artificial Sequence: Synthetic oligonucleotide
  source 1..12: mol_type = other DNA
accgtctttctc

SEQ ID NO: 2881 - DNA, 12 bp, synthetic construct
  misc_feature 1..12: note = Description of Artificial Sequence: Synthetic oligonucleotide
  source 1..12: mol_type = other DNA
acctgatccgca

SEQ ID NO: 2882 - DNA, 12 bp, synthetic construct
  misc_feature 1..12: note = Description of Artificial Sequence: Synthetic oligonucleotide
  source 1..12: mol_type = other DNA
ggttgagaagag

SEQ ID NO: 2883 - DNA, 12 bp, synthetic construct
  misc_feature 1..12: note = Description of Artificial Sequence: Synthetic oligonucleotide
  source 1..12: mol_type = other DNA
cctgttagcgaa

SEQ ID NO: 2884 - DNA, 12 bp, synthetic construct
  misc_feature 1..12: note = Description of Artificial Sequence: Synthetic oligonucleotide
  source 1..12: mol_type = other DNA
cctacatgagac

SEQ ID NO: 2885 - DNA, 12 bp, synthetic construct
  misc_feature 1..12: note = Description of Artificial Sequence: Synthetic oligonucleotide
  source 1..12: mol_type = other DNA
agtctgtctgcg

SEQ ID NO: 2886 - DNA, 12 bp, synthetic construct
  misc_feature 1..12: note = Description of Artificial Sequence: Synthetic oligonucleotide
  source 1..12: mol_type = other DNA
caagctagctgt

SEQ ID NO: 2887 - DNA, 12 bp, synthetic construct
  misc_feature 1..12: note = Description of Artificial Sequence: Synthetic oligonucleotide
  source 1..12: mol_type = other DNA
ctgggagttgtt

SEQ ID NO: 2888 - DNA, 12 bp, synthetic construct
  misc_feature 1..12: note = Description of Artificial Sequence: Synthetic oligonucleotide
  source 1..12: mol_type = other DNA
gctccgaccata

SEQ ID NO: 2889 - DNA, 12 bp, synthetic construct
  misc_feature 1..12: note = Description of Artificial Sequence: Synthetic oligonucleotide
  source 1..12: mol_type = other DNA
tccgtggtatag

SEQ ID NO: 2890 - DNA, 12 bp, synthetic construct
  misc_feature 1..12: note = Description of Artificial Sequence: Synthetic oligonucleotide
  source 1..12: mol_type = other DNA
ccgcactcaagt

SEQ ID NO: 2891 - DNA, 12 bp, synthetic construct
  misc_feature 1..12: note = Description of Artificial Sequence: Synthetic oligonucleotide
  source 1..12: mol_type = other DNA
gtggataaactc

SEQ ID NO: 2892 - DNA, 12 bp, synthetic construct
  misc_feature 1..12: note = Description of Artificial Sequence: Synthetic oligonucleotide
  source 1..12: mol_type = other DNA
atcatctcggcg

SEQ ID NO: 2893 - DNA, 12 bp, synthetic construct
  misc_feature 1..12: note = Description of Artificial Sequence: Synthetic oligonucleotide
  source 1..12: mol_type = other DNA
acaaatcgttgg

SEQ ID NO: 2894 - DNA, 12 bp, synthetic construct
  misc_feature 1..12: note = Description of Artificial Sequence: Synthetic oligonucleotide
  source 1..12: mol_type = other DNA
tctacggcacgt

SEQ ID NO: 2895 - DNA, 12 bp, synthetic construct
  misc_feature 1..12: note = Description of Artificial Sequence: Synthetic oligonucleotide
  source 1..12: mol_type = other DNA
tgtggaaactcc

SEQ ID NO: 2896 - DNA, 12 bp, synthetic construct
  misc_feature 1..12: note = Description of Artificial Sequence: Synthetic oligonucleotide
  source 1..12: mol_type = other DNA
ggtacaatgatc

SEQ ID NO: 2897 - DNA, 12 bp, synthetic construct
  misc_feature 1..12: note = Description of Artificial Sequence: Synthetic oligonucleotide
  source 1..12: mol_type = other DNA
attacccacagg

SEQ ID NO: 2898 - DNA, 12 bp, synthetic construct
  misc_feature 1..12: note = Description of Artificial Sequence: Synthetic oligonucleotide
  source 1..12: mol_type = other DNA
gaaggaaagtag

SEQ ID NO: 2899 - DNA, 12 bp, synthetic construct
  misc_feature 1..12: note = Description of Artificial Sequence: Synthetic oligonucleotide
  source 1..12: mol_type = other DNA
atgctgcaacac

SEQ ID NO: 2900 - DNA, 12 bp, synthetic construct
  misc_feature 1..12: note = Description of Artificial Sequence: Synthetic oligonucleotide
  source 1..12: mol_type = other DNA
ttaggcaggttc

SEQ ID NO: 2901 - DNA, 12 bp, synthetic construct
  misc_feature 1..12: note = Description of Artificial Sequence: Synthetic oligonucleotide
  source 1..12: mol_type = other DNA
actgtcgcagta

SEQ ID NO: 2902 - DNA, 12 bp, synthetic construct
  misc_feature 1..12: note = Description of Artificial Sequence: Synthetic oligonucleotide
  source 1..12: mol_type = other DNA
cacatcagcgct

SEQ ID NO: 2903 - DNA, 12 bp, synthetic construct
  misc_feature 1..12: note = Description of Artificial Sequence: Synthetic oligonucleotide
  source 1..12: mol_type = other DNA
acaaacatggtc

SEQ ID NO: 2904 - DNA, 12 bp, synthetic construct
  misc_feature 1..12: note = Description of Artificial Sequence: Synthetic oligonucleotide
  source 1..12: mol_type = other DNA
ttctcatggagg

SEQ ID NO: 2905 - DNA, 12 bp, synthetic construct
  misc_feature 1..12: note = Description of Artificial Sequence: Synthetic oligonucleotide
  source 1..12: mol_type = other DNA
taagactactgg

SEQ ID NO: 2906 - DNA, 12 bp, synthetic construct
  misc_feature 1..12: note = Description of Artificial Sequence: Synthetic oligonucleotide
  source 1..12: mol_type = other DNA
catcctgagcaa

SEQ ID NO: 2907 - DNA, 12 bp, synthetic construct
  misc_feature 1..12: note = Description of Artificial Sequence: Synthetic oligonucleotide
  source 1..12: mol_type = other DNA
tgaccatagtga

SEQ ID NO: 2908 - DNA, 12 bp, synthetic construct
  misc_feature 1..12: note = Description of Artificial Sequence: Synthetic oligonucleotide
  source 1..12: mol_type = other DNA
ggactatcgttg

SEQ ID NO: 2909 - DNA, 12 bp, synthetic construct
  misc_feature 1..12: note = Description of Artificial Sequence: Synthetic oligonucleotide
  source 1..12: mol_type = other DNA
catagtgattgg

SEQ ID NO: 2910 - DNA, 12 bp, synthetic construct
  misc_feature 1..12: note = Description of Artificial Sequence: Synthetic oligonucleotide
  source 1..12: mol_type = other DNA
cgcgaagtttca

SEQ ID NO: 2911 - DNA, 12 bp, synthetic construct
  misc_feature 1..12: note = Description of Artificial Sequence: Synthetic oligonucleotide
  source 1..12: mol_type = other DNA
caacatcgtagc

SEQ ID NO: 2912 - DNA, 12 bp, synthetic construct
  misc_feature 1..12: note = Description of Artificial Sequence: Synthetic oligonucleotide
  source 1..12: mol_type = other DNA
gataagcgcctt

SEQ ID NO: 2913 - DNA, 12 bp, synthetic construct
  misc_feature 1..12: note = Description of Artificial Sequence: Synthetic oligonucleotide
  source 1..12: mol_type = other DNA
gctatatccagg

SEQ ID NO: 2914 - DNA, 12 bp, synthetic construct
  misc_feature 1..12: note = Description of Artificial Sequence: Synthetic oligonucleotide
  source 1..12: mol_type = other DNA
gctatcaagaca

SEQ ID NO: 2915 - DNA, 12 bp, synthetic construct
  misc_feature 1..12: note = Description of Artificial Sequence: Synthetic oligonucleotide
  source 1..12: mol_type = other DNA
cgatacactgcc

SEQ ID NO: 2916 - DNA, 12 bp, synthetic construct
  misc_feature 1..12: note = Description of Artificial Sequence: Synthetic oligonucleotide
  source 1..12: mol_type = other DNA
ggcaatcatctg

SEQ ID NO: 2917 - DNA, 12 bp, synthetic construct
  misc_feature 1..12: note = Description of Artificial Sequence: Synthetic oligonucleotide
  source 1..12: mol_type = other DNA
tagtctaagggt

SEQ ID NO: 2918 - DNA, 12 bp, synthetic construct
  misc_feature 1..12: note = Description of Artificial Sequence: Synthetic oligonucleotide
  source 1..12: mol_type = other DNA
tattcccacgtt

SEQ ID NO: 2919 - DNA, 12 bp, synthetic construct
  misc_feature 1..12: note = Description of Artificial Sequence: Synthetic oligonucleotide
  source 1..12: mol_type = other DNA
ccgtgacaactc

SEQ ID NO: 2920 - DNA, 12 bp, synthetic construct
  misc_feature 1..12: note = Description of Artificial Sequence: Synthetic oligonucleotide
  source 1..12: mol_type = other DNA
ttgaaatcccgg

SEQ ID NO: 2921 - DNA, 12 bp, synthetic construct
  misc_feature 1..12: note = Description of Artificial Sequence: Synthetic oligonucleotide
  source 1..12: mol_type = other DNA
tatcgcgcgata

SEQ ID NO: 2922 - DNA, 12 bp, synthetic construct
  misc_feature 1..12: note = Description of Artificial Sequence: Synthetic oligonucleotide
  source 1..12: mol_type = other DNA
aattaggcgtgt

SEQ ID NO: 2923 - DNA, 12 bp, synthetic construct
  misc_feature 1..12: note = Description of Artificial Sequence: Synthetic oligonucleotide
  source 1..12: mol_type = other DNA
ccattagttcct

SEQ ID NO: 2924 - DNA, 12 bp, synthetic construct
  misc_feature 1..12: note = Description of Artificial Sequence: Synthetic oligonucleotide
  source 1..12: mol_type = other DNA
cgttccttgtta

SEQ ID NO: 2925 - DNA, 12 bp, synthetic construct
  misc_feature 1..12: note = Description of Artificial Sequence: Synthetic oligonucleotide
  source 1..12: mol_type = other DNA
gttagggagcga

SEQ ID NO: 2926 - DNA, 12 bp, synthetic construct
  misc_feature 1..12: note = Description of Artificial Sequence: Synthetic oligonucleotide
  source 1..12: mol_type = other DNA
tacggtctggat

SEQ ID NO: 2927 - DNA, 12 bp, synthetic construct
  misc_feature 1..12: note = Description of Artificial Sequence: Synthetic oligonucleotide
  source 1..12: mol_type = other DNA
tgctcttgctct

SEQ ID NO: 2928 - DNA, 12 bp, synthetic construct
  misc_feature 1..12: note = Description of Artificial Sequence: Synthetic oligonucleotide
  source 1..12: mol_type = other DNA
taaccttcgctt

SEQ ID NO: 2929 - DNA, 12 bp, synthetic construct
  misc_feature 1..12: note = Description of Artificial Sequence: Synthetic oligonucleotide
  source 1..12: mol_type = other DNA
ggaattatcggt

SEQ ID NO: 2930 - DNA, 12 bp, synthetic construct
  misc_feature 1..12: note = Description of Artificial Sequence: Synthetic oligonucleotide
  source 1..12: mol_type = other DNA
ttactgtggccg

SEQ ID NO: 2931 - DNA, 12 bp, synthetic construct
  misc_feature 1..12: note = Description of Artificial Sequence: Synthetic oligonucleotide
  source 1..12: mol_type = other DNA
tcgttcaggacc

SEQ ID NO: 2932 - DNA, 12 bp, synthetic construct
  misc_feature 1..12: note = Description of Artificial Sequence: Synthetic oligonucleotide
  source 1..12: mol_type = other DNA
tccactagagca

SEQ ID NO: 2933 - DNA, 12 bp, synthetic construct
  misc_feature 1..12: note = Description of Artificial Sequence: Synthetic oligonucleotide
  source 1..12: mol_type = other DNA
gtaatctgccga

SEQ ID NO: 2934 - DNA, 12 bp, synthetic construct
  misc_feature 1..12: note = Description of Artificial Sequence: Synthetic oligonucleotide
  source 1..12: mol_type = other DNA
catcaagcatag

SEQ ID NO: 2935 - DNA, 12 bp, synthetic construct
  misc_feature 1..12: note = Description of Artificial Sequence: Synthetic oligonucleotide
  source 1..12: mol_type = other DNA
atataaggccca

SEQ ID NO: 2936 - DNA, 12 bp, synthetic construct
  misc_feature 1..12: note = Description of Artificial Sequence: Synthetic oligonucleotide
  source 1..12: mol_type = other DNA
tgatccgggtat

SEQ ID NO: 2937 - DNA, 12 bp, synthetic construct
  misc_feature 1..12: note = Description of Artificial Sequence: Synthetic oligonucleotide
  source 1..12: mol_type = other DNA
cattgcaaagca

SEQ ID NO: 2938 - DNA, 12 bp, synthetic construct
  misc_feature 1..12: note = Description of Artificial Sequence: Synthetic oligonucleotide
  source 1..12: mol_type = other DNA
ggtggcatggaa

SEQ ID NO: 2939 - DNA, 132 bp, synthetic construct
  misc_feature 1..132: note = Description of Artificial Sequence: Synthetic polynucleotide
  source 1..132: mol_type = other DNA
cctacgggaggcatcaggcagatctcgtcccttgtctccacgagactgattatgattacagttaacagtatcttaatgattacagttaacagtatcttaagtcagtcagccggattagataccctagtagtc

SEQ ID NO: 2940 - DNA, 132 bp, synthetic construct
  misc_feature 1..132: note = Description of Artificial Sequence: Synthetic polynucleotide
  source 1..132: mol_type = other DNA
cctacgggaggcatcaggcagatctcgtcccttgtctccacgagactgattctgactgcagttagcagtacctgaatgctgacagtcagcagtacctgaagtcagtcagccggattagataccctagtagtc

SEQ ID NO: 2941 - DNA, 132 bp, synthetic construct
  misc_feature 1..132: note = Description of Artificial Sequence: Synthetic polynucleotide
  source 1..132: mol_type = other DNA
cctacgggaggcatcaggcagatctcgtcccttgtctccacgagactgattcgacggctcaggcctcagcgtggccgacggctgaggcctcagcgtggcagtcagtcagccggattagataccctagtagtc

SEQ ID NO: 2942 - DNA, 132 bp, synthetic construct
  misc_feature 1..132: note = Description of Artificial Sequence: Synthetic polynucleotide
  source 1..132: mol_type = other DNA
cctacgggaggcatcaggcagatctcggctgtacggattatcaccaggtgtatgattacagttaacagtatcttaatgattacagttaacagtatcttaagtcagtcagccggattagataccctagtagtc

SEQ ID NO: 2943 - DNA, 132 bp, synthetic construct
  misc_feature 1..132: note = Description of Artificial Sequence: Synthetic polynucleotide
  source 1..132: mol_type = other DNA
cctacgggaggcatcaggcagatctcggctgtacggattatcaccaggtgtctgactgcagttagcagtacctgaatgctgacagtcagcagtacctgaagtcagtcagccggattagataccctagtagtc

SEQ ID NO: 2944 - DNA, 132 bp, synthetic construct
  misc_feature 1..132: note = Description of Artificial Sequence: Synthetic polynucleotide
  source 1..132: mol_type = other DNA
cctacgggaggcatcaggcagatctcggctgtacggattatcaccaggtgtcgacggctcaggcctcagcgtggccgacggctgaggcctcagcgtggcagtcagtcagccggattagataccctagtagtc

SEQ ID NO: 2945 - DNA, 132 bp, synthetic construct; identical to SEQ ID NO: 2939
  misc_feature 1..132: note = Description of Artificial Sequence: Synthetic polynucleotide
  source 1..132: mol_type = other DNA

SEQ ID NO: 2946 - DNA, 132 bp, synthetic construct; identical to SEQ ID NO: 2940
  misc_feature 1..132: note = Description of Artificial Sequence: Synthetic polynucleotide
  source 1..132: mol_type = other DNA

SEQ ID NO: 2947 - DNA, 132 bp, synthetic construct; identical to SEQ ID NO: 2941
  misc_feature 1..132: note = Description of Artificial Sequence: Synthetic polynucleotide
  source 1..132: mol_type = other DNA

SEQ ID NO: 2948 - DNA, 132 bp, synthetic construct; identical to SEQ ID NO: 2942
  misc_feature 1..132: note = Description of Artificial Sequence: Synthetic polynucleotide
  source 1..132: mol_type = other DNA

SEQ ID NO: 2949 - DNA, 132 bp, synthetic construct; identical to SEQ ID NO: 2943
  misc_feature 1..132: note = Description of Artificial Sequence: Synthetic polynucleotide
  source 1..132: mol_type = other DNA

SEQ ID NO: 2950 - DNA, 132 bp, synthetic construct; identical to SEQ ID NO: 2944
  misc_feature 1..132: note = Description of Artificial Sequence: Synthetic polynucleotide
  source 1..132: mol_type = other DNA

SEQ ID NO: 2951 - DNA, 110 bp, synthetic construct
  misc_feature 1..110: note = Description of Artificial Sequence: Synthetic polynucleotide
  source 1..110: mol_type = other DNA
gcagatctcgtacgcgaatcccttgtctccacgagactgattatgattacagttaacagtatcttaatgattacagttaacagtatcttagtcatgacagtcagtcagcc

SEQ ID NO: 2952 - DNA, 110 bp, synthetic construct
  misc_feature 1..110: note = Description of Artificial Sequence: Synthetic polynucleotide
  source 1..110: mol_type = other DNA
gcagatctcgtacgcgaatcccttgtctccacgagactgattctgactgcagttagcagtacctgaatgctgacagtcagcagtacctgagtcatgacagtcagtcagcc

SEQ ID NO: 2953 - DNA, 110 bp, synthetic construct
  misc_feature 1..110: note = Description of Artificial Sequence: Synthetic polynucleotide
  source 1..110: mol_type = other DNA
gcagatctcgtacgcgaatcccttgtctccacgagactgattcgacggctcaggcctcagcgtggccgacggctgaggcctcagcgtggcgtcatgacagtcagtcagcc

SEQ ID NO: 2954 - DNA, 110 bp, synthetic construct
  misc_feature 1..110: note = Description of Artificial Sequence: Synthetic polynucleotide
  source 1..110: mol_type = other DNA
gcagatctcgtacgcgaagctgtacggattatcaccaggtgtatgattacagttaacagtatcttaatgattacagttaacagtatcttagtcatgacagtcagtcagcc

SEQ ID NO: 2955 - DNA, 110 bp, synthetic construct
  misc_feature 1..110: note = Description of Artificial Sequence: Synthetic polynucleotide
  source 1..110: mol_type = other DNA
gcagatctcgtacgcgaagctgtacggattatcaccaggtgtctgactgcagttagcagtacctgaatgctgacagtcagcagtacctgagtcatgacagtcagtcagcc

SEQ ID NO: 2956 - DNA, 110 bp, synthetic construct
  misc_feature 1..110: note = Description of Artificial Sequence: Synthetic polynucleotide
  source 1..110: mol_type = other DNA
gcagatctcgtacgcgaagctgtacggattatcaccaggtgtcgacggctcaggcctcagcgtggccgacggctgaggcctcagcgtggcgtcatgacagtcagtcagcc

SEQ ID NO: 2957 - DNA, 110 bp, synthetic construct; identical to SEQ ID NO: 2951
  misc_feature 1..110: note = Description of Artificial Sequence: Synthetic polynucleotide
  source 1..110: mol_type = other DNA

SEQ ID NO: 2958 - DNA, 110 bp, synthetic construct; identical to SEQ ID NO: 2952
  misc_feature 1..110: note = Description of Artificial Sequence: Synthetic polynucleotide
  source 1..110: mol_type = other DNA

SEQ ID NO: 2959 - DNA, 110 bp, synthetic construct; identical to SEQ ID NO: 2953
  misc_feature 1..110: note = Description of Artificial Sequence: Synthetic polynucleotide
  source 1..110: mol_type = other DNA

SEQ ID NO: 2960 - DNA, 110 bp, synthetic construct; identical to SEQ ID NO: 2954
  misc_feature 1..110: note = Description of Artificial Sequence: Synthetic polynucleotide
  source 1..110: mol_type = other DNA

SEQ ID NO: 2961 - DNA, 110 bp, synthetic construct; identical to SEQ ID NO: 2955
  misc_feature 1..110: note = Description of Artificial Sequence: Synthetic polynucleotide
  source 1..110: mol_type = other DNA

SEQ ID NO: 2962 - DNA, 110 bp, synthetic construct; identical to SEQ ID NO: 2956
  misc_feature 1..110: note = Description of Artificial Sequence: Synthetic polynucleotide
  source 1..110: mol_type = other DNA

What is claimed is:

1. A sequencing control composition comprising a first liposome and a second liposome wherein said first liposome encapsulates a first nucleic acid construct, and the second liposome encapsulates a second nucleic acid construct, wherein said first nucleic acid construct comprises a first barcode sequence fragment, a first universal sequence fragment, a first primer binding site fragment, and a second primer binding site fragment, and said second nucleic acid construct comprises a second barcode sequence fragment, a second universal sequence fragment, a third primer binding site fragment, and a fourth primer binding site fragment, wherein the composition of the membrane forming the first liposome and the second liposomes differ from each other, and the first and second nucleic acid constructs differ from each other based on the nucleic acid sequence of the first and second barcode sequence fragment;

said first barcode sequence fragment being linked at its 5' or 3' end to said first universal sequence fragment to form a first barcode cassette, and said first binding site fragment is linked at the 5' end of the first barcode cassette and the second binding fragment is linked at the 3' end of the first barcode cassette, and said second barcode sequence fragment being linked at its 5' or 3' end to said second universal sequence fragment to form a second barcode cassette, and said third binding site fragment is linked at the 5' end of the second barcode cassette and the fourth binding fragment is linked at the 3' end of the second barcode cassette;

further wherein said first and second universal sequence fragment serves as a marker for identifying a junction between the respective first and second barcode sequence fragment and the first and second universal sequence fragment, wherein the components of said membrane forming the first and second liposomes are selected from the group consisting of i) a lipopolysaccharide, a peptidoglycan and a phospholipid;
ii) a peptidoglycan, teichoic acid and a phospholipid;
iii) a cholesterol, and a phospholipid; and
iv) a phospholipid, and a phospholipid with a polyethylene glycol (PEG) covalently linked to the phospholipid.

2. The control composition of claim 1 wherein the first nucleic acid construct comprises a first and a second universal sequence fragment wherein the first universal sequence fragment is linked to the 5' end of the first barcode sequence fragment and the second universal sequence fragment is linked to the 3' end of the first barcode sequence fragment, and the second nucleic acid construct comprises a third and a fourth universal sequence fragment wherein the third universal sequence fragment is linked to the 5' end of the second barcode sequence fragment and the fourth universal sequence fragment is linked to the 3' end of the second barcode sequence fragment.

3. The control composition of claim 2 wherein the first and second nucleic acid constructs each further comprise a GC content fragment, wherein a first GC content fragment is flanked by said first and second universal sequence fragments of the first nucleic acid construct and a second GC content fragment is flanked by said third and fourth universal sequence fragments of the second nucleic acid.

4. The control composition of claim 3 wherein said first and second nucleic acid constructs differ from one another based on different percent GC content of the respective first and second GC content fragments.

5. The control composition of claim 4 wherein one or more of the first and second GC content fragments has a GC content selected from the group consisting of about 1 to about 40 percent, about 40 to about 60 percent, and about 60 to about 100 percent.

6. The control composition of claim 1 wherein said composition further comprises a third liposome, wherein the third liposome encapsulates a third nucleic acid construct, wherein said third nucleic acid construct comprises a third barcode sequence fragment, a third universal sequence fragment, a fifth primer binding site fragment, and a sixth primer binding site fragment, said third barcode sequence fragment being linked at its 5' or 3' end to said third universal sequence fragment to form a third barcode cassette, and said fifth binding site fragment is linked at the 5' end of the third barcode cassette and the sixth binding fragment is linked at the 3' end of the third barcode cassette;

said third liposome differing from said first liposome and second liposome based on the composition of the membrane forming the third liposome, and the third nucleic acid construct differs from the first and second nucleic acid constructs based on the nucleic acid sequence of the third barcode sequence fragment relative to the first and second barcode sequence, wherein the components of said membrane forming the third liposome are selected from the group consisting of i) a lipopolysaccharide, a peptidoglycan and a phospholipid;
ii) a peptidoglycan, teichoic acid and a phospholipid;
iii) a cholesterol, and a phospholipid; and
iv) a phospholipid, and a phospholipid with a polyethylene glycol (PEG) covalently linked to the phospholipid.

7. The control composition of claim 6 wherein the length of the first, second, third, fourth, fifth and sixth primer binding site fragments independently range in length from about 15 base pairs to about 30 base pairs and the length of the first second and third nucleic acid constructs independently range in length from about 80 base pairs to about 300 base pairs.

8. The control composition of claim 1 wherein said first liposome comprises a lipopolysaccharide, a peptidoglycan and a phospholipid, and said second liposome comprises a peptidoglycan, teichoic acid and a phospholipid.

9. A kit comprising the control composition of claim 1 and a reagent selected from the group consisting of a reagent for nucleic acid extraction, a reagent for nucleic acid purification, a reagent for library preparation, and a reagent for sequencing, and i) one or more probes that specifically bind to said first and second barcode sequence fragments; or
ii) PCR primers that specifically bind to the first binding site fragment and second binding site fragment of said first nucleic acid construct and PCR primers that specifically bind to the third binding site fragment and fourth binding site fragment of said second nucleic acid construct.

10. The kit of claim 9 wherein the first nucleic acid construct comprises a first and a second universal sequence fragment wherein the first universal sequence fragment is linked to the 5' end of the first barcode sequence fragment and the second universal sequence fragment is linked to the 3' end of the first barcode sequence fragment and said first nucleic acid construct further comprises a first GC content fragment, wherein the first GC content fragment is flanked by said first and second universal sequence fragments, and the second nucleic acid construct comprises a third and a fourth universal sequence fragment wherein the third universal sequence fragment is linked to the 5' end of the second barcode sequence fragment and the fourth universal sequence fragment is linked to the 3' end of the second barcode sequence fragment and said second nucleic acid construct further comprises a second GC content fragment, wherein the second GC content fragment is flanked by said third and fourth universal sequence fragments.

11. The kit of claim 9 wherein the kit further comprises a) a composition comprising a lipopolysaccharide, a peptidoglycan and a phospholipid, b) a composition comprising a peptidoglycan, teichoic acid and a phospholipid, c) a composition comprising cholesterol, and a phospholipid; and d) a composition comprising a phospholipid, with PEG covalently linked to said phospholipid, wherein each of a), b), c) and d) are provided as separate reagents.

12. The control composition of claim 1 wherein the first liposome has higher concentrations of one or more components selected from the group consisting of a lipopolysaccharide, a peptidoglycan, teichoic acids, PEG, cholesterol, and cationic lipids relative to those present in the second liposome.

* * * * *